United States Patent 7,816,076 (THERAPEUTIC TARGETS IN CANCER) - sequence listing, part 3

SEQ ID NO: 189 - DNA, 29328 bp, Homo sapiens
  misc_feature (1)...(29328): n = A,T,C or G
acaaaaaaatttatttatttactttcatttatttatttatttatttattttgagatggagcctctccctgtcacccaggctggagtgcggtggcacgatctcggctcactgcaacctttgcctcctgggttcaagcgatttctggcttatttttgtatttttagtagagacgggggttttaccacgttggccacgctggtcttgaactcctgacctcaagtgatccacccacctcggcctctcaaagtgctgggattactggcgtgaattaccgcactgggccaaaaatatttaaaaattagccaggcgtggtggtgtgtgcctgtggtcccagctacctgggagactggggtggaaggactgcttaaccccaagaggtcaaggctgcggtgagctgtgattgtgccaccacactccagcctgggcgacagagcgagactctgtctcaaaaaaaaaaaaaaaggtgaggtcacccagggtatcagtggacaagctgagaacaaaaccaaagtttctaacaccgaaaatttgtcttctgctcatcccagcctgaaaggaaggtgaaccaagatgcaatccatgcccattcaagtggggtctgtgtgtccaggcagaggtgtctgccctctacaaagggcacaggggagagagtgatgcttaacccaaaggaggtctcgctgatggtggaatttcaggcaccgtgtttatgtttggcctaattagcttgagaccagtgtccttgacgggaactaagacgccccccacgcccatccccggctcccaggctctctccacccaagttctgcccaccagggcacactgcttccctctgccacctcctcttcccacgagccctggtacaccctagattctcagggctgtggctccttgctttacaaatgagtaagttggtggcagggaaggaagtgggctgggccatgaccaagagtcactatgattcacggggaaaaccctgccctcccgattcaactctgtgtgcaaaaaggttttgtgcgggttcctagggtctcagggtcaatggatgtagatagaccactagaggtatacacagccactgtccaccaactctcccaccccccgggtctgcctacagccctggatggggatcctgtaccgggggggcggttggggggttggacaggtgtgggttgaggtgttgtttacatgttgaacacactggggttccaggtaagtttccgtcagaagaaagcacttcactgctgaggcagaaatttcaaaatattgaaccacttttcgatcctggcagaagggaattttcccagggtgataaaagtgttctaaaattagatttgagtgatggctgcccaaaaggaattatgatattattcaagaaatcatggctttgctgaacaacagaaaactcgaacactgagcatttgaagatattaaggaattgttgatttttatgttcactgtttaggtgaaatgatagcattgtgagtgtgttatttttaaatgagtccttatcttttaaagatacaggcagaaatagctataaaatgatctgatggctgggatttgctttcaaataatacaggagagggccgtgggtgaggagagggaaccagattgcctatgagctgagtgatgggtatgtggttgcgagggcagacaccattcttctctctgctttcgatgggtgcgtagaatttcccataataaaaagtggtttttaaattgttttgaccattggcctcgcgcggtggctcacgcctataatcccagcactttgggaggcagaggcaggcagatcacttgagggcaggagttcgagaccagcctgggcaacctggtgaaaccccatctctattgaaaacacataaaaattacccgagtatagtggcatgcgcctgtaatcccagccactcgagaagctgaggcaggagaatcgcttgaacccgggaggcagaggttgcagtgagctgaggtcgtgccactgcactccagcctgggcaacagagcgagactccatctcaaaaaagaaaaaaaaaattgttttaaccattctaaaggaatgagaaaagaattctacaacttttgtttttttgtttttttttttgagacagagtctcactctgtcccccaggctggagtgcagtagcgtgatcacaacttactgcagcttccatctcctgggctcaagtgatcctcctgcctcagcctccagagtagctggaattacaggcatgtgccaccatacctggctaatttttttttttttttttttgagatgaagtttcactcttgttgcccaggctggagtgcaatggcgggatcttggctcactgcaacctctgcctcctgggttcaagcgattctcctgcctcagcctccccagtcgctgggattacaggcatgcgccaccatgcccagctaattttgtatttttagtagagacggggtttctccatgttggtcaggctggtctcgaactcccgacctcagatgatctgcccgcctcagcctcccaaagtgctgggattataggtgtgagccactgtgcccagcctttctttttattttatttttagtagagatgggactcactatgttgccctggctggtctgaaactcctgggctcaagcaatcctcacacctcagcctcccaaaatgctggggttacaggagtgaggcaccatgcccaacccaggcctaaccataattctaaatccaagtccaaccccttcccactttcctgaagggaaaaatgaggtgcagagagaggaaggaacccctaaccaggtccctttagggtcccaagagaaccctggcactctctgctggcctccatccccctaactctgcccttcacttcctcccctccagcaccttccagaaaagctctaggtggctagtccccctctgaccaccttctcccactttcccctgcccctcactcagctccagtcacaccaggctccctgctgtccttatgctcatcaaagcccctcctgccccagggccttgaattcacttgttgtaccttctaccaaaaacactctcctcccacacacccacaggctccctcctctgtcgcctccttcaggccagaaaaagcgccaccaccaccacctcccaaactaaaacagcaacccctgctcctctctatccacttgccctattttatttaattttatttattttgagacacaatctcacactgttgcccaggctggaatgcagtggtgcaatctcagttcactgcaatctccacctcttaggctcaagcaattctcccaccttagcctcccaagtagctggaattactggtgcacaccaccaccacgcctggctaattattgtacttttttgtagagataggatctcactgtggtgcccaggctggtctcaaacgcctggcctaagcgatccacccaccttggcctcccaaagtgctgggattacaggcgtgagcccctgcacctgacctattttactttttatagcttttatctctgcctgacattaaatgccatatcaggttttttttattattattattgcccatctccctccaataggatttagcccaacaaaggaaaggatgtctctgtgcaaacagcctggtacatagtccatgcttgacaaatatttgttaaatgattgaatggcttggaaaaacccagatgaatgaggtgaggagggtggggacgggtatccaagcacagggaacagcctatggaaaggtctggagcttctccgatccacctgcctcctctcctgcatggaagcctaggtgctttttttttctgagacagagtctcactctgtcacccaggctggagtgcagtggtgtgatctcggctcacagcaacctctgacttccgggcttaagtgattctcctgcctcagcctcctaagtgtctgggattacaggtgcccaccaccacaccgggctaattttgtattttttttagtagaggtggggtttctccatgtcggtcaggctggtctcgaactcccgacctcaggtgatccacccgcctcggcctcccaaagtgctgggattataggcgtgagccaccacgcctggccacctgggtgttctttctagggtcaggaattaaggggacatttggtcctttctccccaagaacaacctctccaggcccagccagagccaactccaggccttgacaggccggcacaggaagccacaccctgagcaaatatgacggccccctctgcctcgcccaagataaggggaggttgaaaggggtttggaaacctgcttcagcctaagacattagctccagccaaaccctcagtctcaagggcctccccatccctgcccagagaggacaggacaaggattctgccacggaggcccaagtctgacgtttacatctaatatatattgatgatgtcagtggtgggcagggtcttgaagagcagataaaggagttcccagcctccctcccgctcccaagggaactaagtgactggtgagacaagagggctgggcgggcaaggggtgacccgtgtccccagatggctgtgcagagaagataagactcatctgctccaatcttatgaggcaatggcccggggcctcagtttacttgtctgcaaaatgggttttcttgggggtgggcagcggggagatggataacaggaaaagctgaagctgtcaaaaagaataatgggccaggcacggtggctcacacctgtaatcccagcactttgagaggccaaggcaggtggatcacttgaggttaggagtttgagaccagcctggccaacatgtcaaaaccctgtctgtactaaaaatattaaaattagccaggcatggtggcgcgtgcttgtaatcccagctactcgggaggctgaggtgagagaatcgcttgaacctgggaggtggaggttgcagtgagccaagatcgcaccactgcactccagcctggatgacagatcaagactccatttaaaaaagaagaagaagaagaagaagaagaagaatgatatcagcagaatacatctacaagctgaccacttctcccatccctggttcagccgccactacctcctgcctggtccagcactacccaacaggagcaagagtggagccgcaaacacaattcaaccttttccagcctcatctcatgaagaaaggtgaaacgaatgtatttaacacaacatatgcaaaatgtcatttcagcacagaatcaatataaaaaactgattatctgttttacattattgtgtatgcatgcgctcttttttttttttttttttcttaatgagacaacaaggtcttgctctgtcgcccaggctggagtgcagtggtgagatcacagctcactgcagactcaacctcctgggctcaggcgatcctcctacctcagcctgccaaatagctgggactacaggcgtgcaacaccactcctggctcatttttaaatttttttgtagagacgtgctctacgctgcccaggctggtctcgaactcctgggctcaagccatcctcccgcctcagcctcccaaaatgctgggattacaggtgtgagccaccgcgcccggccccccttattgaacctctactccaatgtcgctctgacaatgtcgccttgctgccctgcataaaccagtgccccgaccacctccatcccttcccctgctttatttttctccacagcattgtccccacctgttctaacactgctcatgtttgtattcgtctattaactgtctccccaatcaataggtcagctctgtgtctaccgtattcacggctgtaaccccacagcgcctagcgcagtgcccggcacatagttggtgctccataaacatttgtcaaatggtggaggaacaacgaccactgtgcccccagtacgtgctctgaggcaggcccagcacggaacactccatgtgcctattttgatcctcagaagagtcccagggaagtcaatgtcatgaacaccccccacccactgcacaaacaggaaaaagcccctgcccacaagaaccccgtctgctttctgcgcagcccggcggcgcacagcaggtgctaaagagcctgcagctcttgactgaaccaaggatctgggctcacagccgggagcaccagaggaggggccagggaggtggaggatgggggcagactaggaagggtggatgtgacgatagagggcctctagagcccggcctggtcacactccgcaggcagacagcagatcaccaggaacctgagcctctctgaagactcctctctctgtgtcatccacacctggtgtccagttccacaaacatgctgtgagcctctgctctgtgccaggtgatttgctgggcagtgctggggacacagtggtgacagcccagccgtgcccagctgaggctcccaggccagtgggggaaaaagacccagccccagacagcgagaacccaaggcagtcagggctgagacagggaattccaggccctgaagtccaggagggcttcctggaggagagggtttggggaaggcagtggaatagagcagagggaagcagggatattctgggtagagtgcaagtgaaacagaagaactgaagcagagggttcccggaagcaagtggtattctatgtagctggtcaggtgggcaggagtcaggccgggcagggcctcctgggctacagtgaggaacctgggcttcctcccaagggcactggggagccacagcaggttctgagcacggaggggcagaggcaggtttttgttttggaaagagcctctgtctgccatgtggaggggcaatgggagtcggggagaccagggccagagactagggaggaggctggtggggagacaggaggacccaggcaaggtggggtggtggagtggtcacctagaccagggcaggggcttcagggagggagagaagatatacgtagagtcagttgccagaaggggtggcgtgttcggggagtagggggaggcatcagggatgaggccccaggtctcttttcccagcgatgaggtgggtagtggcgccttccctgataagggcaccaggggaagatacacttctgggggaagatgccaaggtcagtttgggacaaggtgagtgagaggtgcccagggacatcagggaggcatcctgattgatactgggatgaggtcccagtgctctgggccaggacgcagaagagtgaggtgaggtcacaggtggggagaggggagcaggaggcgccaggacatcctctgtgcctctcacctggcctcacccgcacctcctcagggccttctcccccttgttagagccctgccccacgagggcagcccaggacacagtgctggaggcaaaccaggacaggtgagcacaggtgtggccccctgcccggaagcaggctgcagaggcctcagaggaaccagggctcagaagccatcaggatgcaggtcataagaacacagctatcagcagctctggcaccacaaccccctcggctcctgcccagcatcatctcagagacaccttccctgttaccctccctccaccccaatttaaagtagcaaaccaggccaggggcagtggctcatggctgtaatcccagcactttgggaggccaaggtgggaagatcacttgaggccaagagtttgagaccaggcagagcaacatagcgagatcccatctctacaaaaaataaaatggcaaatcccctttctgactttatttttcaatctgacgtggaagatatttacctttcctttatttactccgcaaatgtcggccccctgagggcagggatttcatccgtcttgtgcacggctgcatcctcagcgcctagaacagcacctggcaaacaataggtgctcattcagtatttgtccaataagtgaatgagtgatttactgagcatttactctgcgccagtcgtggtaagtactgtacttcacatgtgtatctacttaatcctttcaacagccctgtgatgtgagtactattgttttccctattttacaaataaggaaactgaggcttggcagagtccataaattgcccagggtcctggaggtaggaaacagtggaactatgtccagagcctatacttttttttttttgagatggagtttcactcttttgcccagggttcaagcaattctcctgcttcagcctcccaagtagctgggattacaggtgcccgcgaccacacccagctaatttttgtatttttagtagagacagggtttcaccatgctggccaggctggtcttgaactcctgacctcagttgatccacccacctcggcctcccaaagtgctaggactacaggcatgagccactgcgtccggccatgagccaccacgcccggccagagcctatacttttaataacaggcataccaatcagacccacgtccaccaggctctggcttaaatccctgacttgtagcctctcactaactgctgtcaacaaacctgaagtagggtccatatcatctctatttttttgtttgtttttgaaatggagtcttgctctgtcacccaggctggagtgcagtggcaggatctcggctcactgcaacctctacctcctggattcaagcgattctcctacctcagcctccctagtagctgggattacaggcatgtgccaccatgaccggctaacttttattttttgtttttgcttttgttttttgagatagagtctcactctgtcacccaggctggagtgcagtggtgtgatctcagctcgctgcaacctccacctcctgggttcaagagattctcctgcctcagcctctcgagtagctgggactacaggtgcacaccaccacacccagctaattttttatatttttagtacatacgaggtttcaccatattggccaggctggtctcgaactcctgacctcgtgagccacctgccttggcctcccaaagtgttgggattacaggcgttagccaccacacccagctaacttatatttttaatagagacggggtttcgccatgttggtcaggctggttgcaaactcctcacctcaggtgatctgcccatctcagcctcccaaagtgctgggactacaggcacctgccaccacgcctggctatttttattattattatttttagtagagatggggtttcgccatgttggccaggctgatctcgaactcctgacctcaaatgatccgcctgccttggcctcccgaagtgctgggatgacaggcatgagccagtgcacccggccatcatctctatttatcagaataataaatggagactcaacaagggactgtccccagccccactttgggtaagtgcagagctggtgtcaaaactcagctctccttggccccaaagcctccgaatacgcccatttgacagagaggggaaaacaaggcctccgaagtgggagaaagagaatgtgaacttctgagcactttgcaggaagccaacaagaaggagagccccaaagaaagcatgtggccatacagtttcctgcccttctgtctgggtttgcacacagagcagggctcaaatcccctctccctgcaggaacccggacaagtgggagtccccacctagctcatctccatctgcaaaggggggtcctaaaggtgcccactttacagggttgttttgccatccgctgagacaacacctgtaggtcccctgcactgggtggggctgggaaaggtgcagtcaccttttactgattttattccttggtgactcccaggctctctgaggaggccacgggcctgggtggttggtaagaactacccgaaaaccttcccctacttttcctctcttctcctcggtgacctggttcctctcccagtaccaaatccaggccctcggcacaaagagggttaggcggctgccccaggaggcctgcccaggtcacggcctctggccggtgcccgccacacccaccctggtacccaaaccgggccccagatccttggtgactcgatccctccaaattcaggtgatctcccctggctccaaatcaccaaaccctcccaggtcctgcggcagacggagccgagccccaaccaggaagggagtccgagcactgggacttcaacgccaccatctccaagactcggtttggggtgaaagatggcgctgactgggtacagctggctgctcctcagtggtgagcgagaatggcaccccccagcacctcagccccccgaggaccccagggaggggaggggacccccagtctgagagagggaaggtgtgagcagaagtccagcgtgctagggagggagggcagccctgcttcacaccggcagtttacccctccaagaggcatctgcattgggcaggctggggacagccacccagagaggttttcagggtgggctttggagatttctaagcccagggcacaagccaggacaagggagccgctgttgctccttcattcctgcaggtttctgttttatcagctatggaagccttgatgaggctaaactcttcccagcagctgtttctcccggaagatgtagcttagggcagttgcctttcccttctcagcctctgtgtacccacctgtgaatggggcctcactgacagggtcatgtaaaggtcattataagcagcaccacatatgccgtgtgcccggagctgttctgagagcttctcatggtttaaaaccacctatgaggggccgggcaaggtggctcacaccactaatcccagcactttgggaggccgaggcgggcggatcacctgaggtcaggagttcaagaccagcctggttaacatagtaaaaccccatctctactaaaatacaaaaaattagctaggtgtggtggcacatgcctgtagtcccagctgctcgggaggctgaggcaggagaatcacttgaatccaggaggtggaggtcacagtgtgccgagactgcaccactgcactccagcctgggcaacaaagcaagactccatctcaaaaaaaaaaaacaaccccaaaccacctatgagggaggcccacacatgaaccgcacttcatagggagaaaacgaggctcagaaaggtgaaaccattggccgctgtcacacggccagagagtggcaggactgagggctagacccagagaccctcactcctagccacactctaacagcctggaaagtaccagaaagctggccagccatgtcagtccttttgacgtgagcactgtcacagccgcccgttccgggcattcaaaccacacgtcattcaaacccaagcagccccgaccagctcatcgggcttggggctgatctgcttggttgagaaggaaaggggtggagtgtgttcatcttacccctgctttccgctgtaggcgagcttggagaggcagaggcagagccccagactgggagtcaggacccagggggcaggccctgacatcctacgtggggccatacaattagctgggctggatacgcagccggatctcgcgagacttagtttggtgactgtcacgatgggaaaaccctttgggtccggcttaaagccgcaggtcctgtgggccgagcacttgctttgcacttgctgtatgcaagatgtgatgctagatccttggcacagtccatcagacccaatcctcacaacacacgcctccctccctcggactgagtccctccctgggactgagctcctgcatctgactaacatgtattgggcacttactgtataccaggcattgtaagcatggtatgtatacagaatccttacaaccttaccaggcaggtagacctgtcatccccatgtgagagttggaagaacagaaacacagagaaagacagtgtactcgaagccatgcagataaactcccagaaagattaggtggctgagatgttgagagtcagagttgcaggttcaaatcctggttttgcctgtcctcatttacacagaggacactgggctggggacgtgccccgagcctgagtctcttcttctgtcaaatggggcgattgatcaaacctgcctcatccaacccctctgactcctcttcctcagccacattcctgaatgtgggggccgagatctctatcaccctggagcctgcccagccgagcgaaggggacaacgtcacgctggtcgtccatgggctttcgggggaactgctcgcctacagctggtatgcggggcccacactcagcgtgtcatacctggtggccagctacatcgtgagcacaggcgatgagactcctggcccggcccacacggggcgggaggctgtgcgccccgatggcagcctggacatccagggcatcctgccccggcactcaggcacctacatcctgcagaccttcaacaggcagttgcagaccgaggtgggctacggacacgtgcaggtccatggtgagacaccccccaacacccgcctctgccccagctgggccttcccatctccttctcaatccttcttttttttaaaaaaaaaaaaaatccaacaaatcatcagggaaaccatcagggaataagtttctaaaataacctcaaaatgctcacctccttcaagatggcctccaggattagacctgcctcctaaaaccattctttgtccctccggctgagggtgtgggggcccagccacaatccggccatgccccttgttgggggaagggaaggccctcagagcaggtggtgtccggccccctccccctctgtctcttgcccccacagagatcctggcccagcccacagtcttggccaacagcacagcgctggtggaacgtcgagacaccctgcgccttatgtgcagcagccccagccccaccgccgaggtccgctggttcttcaacggtggggccctgcccgtcgctctccgcctgggcctgtcccctgacggccgggtgctggccaggcatggcatccgccgggaggaggccggcgcctatcagtgtgaggtgtggaacccggtcagtgtcagccgcagcgagcccatcaacctgaccgtgtactgtgagtcctcctggccccactggagatacccagtgtccaaacctcatggatggggaaactgaggccaggagagggggcctaagggcacacagcgagtcagcaggcaagctgggattggggaccagggacccctcttaaagtgcacttgccctcgccaggtgcagtggctcacgcctgtaatcccagcactctggggggcctaggcgggaggatcacctgaacccagaagtttgagaccagcctgggcaacatggcaagaccccatctctaccaaaaaacataaaaattagccaggcatggtggcacatgcctgtagtcccagccactcaggaggctgagatgggaggattccttgagccccggaggccgaggttgcaggtgcagtaagctatgattgcaccactgcactccagcctgggcgacagagcaagatgctgtctcaaaaaacaaacaaacaaaaaaaaaaacaacaacaaacaaaaaaaatacacttgccccatatcctaaaggacttctacagaccacctttactattgaataatccttcagttaggagcaatatctacagagaaaggaaacagggccagttggtttgaaaagggagcaggggagggaatagtgtaatgggaggggacacaaaatttaacaacataaccaaagcatgcagtcgttcccaggagcagcagatgtgcagtgtggaatcctgggaaaataaatcaccaaggtacatgaggacccatgatgtagaaaaacttagtgcctacaatcctagaatcttacaaccagagaattccagacttcagaagcactgaattccagactctgagaatcttagaacctctagacgcagagattcttagaatcttagaatctaaccctgaaatcttagtctagaatcttagaaacatagatttctagnnnnnnnnnnnnnnnnnnnnattctacactcttagaatggctttgtcagaaaaaaaaaaatcatttaggctttttttatttgtcaatggagccatagatttcaaaaataccttgaaatattatcttgcccaacacattctttttacaggagagaaaggtgagatcctctgagagggagtgattctcaagatcctagaacaagttagagttaaggccagagctttttttcccctccactaggccaagatattcccagggacctagcttggtggagagaaaaccaggggtaccaacctccactcctccttccctctactgccccatctatctccctcctgcccccacagttggcccagagcgtgtggccatcctccaggattccaccacccgcacaggctgcaccatcaaagttgacttcaacacgtccctcaccctgtggtgcgtgtccaggtcctgcccagagcccgagtatgtgtggaccttcaacgggcaggccctaaagaacggccaagaccacctcaacatcagcagcatgacagccgcccaggaggggacgtacacatgtattgcgaagaacaccaagaccctgctatctggatctgcctcagtcgtggtcaagctctctggtgagtcacccccagcctgaccaccccccagtccccatggaggcctcatcaggctgcgaaggttaagccaccatttgcccaacagagaattggaacatggtagattcacagttcattcatgagctgtgacaaagtggcatatcaggcagatctgtttgcatctgggtctaaagagagacagcccgtgtcctgttcacctagagaacaaatggcaaaccattgtgggttgacagagtggaaaatcactcagatatcacttcaggtgggtgccactgctctaaattcagtcaccagctgtttaggggcttgaccctctacccgcccccaccccaccacacagacagctgaaattctgtgcagccaactagactacccagttatctgacccagatgacgggtatacacacacacacacacacacacacacacacacacacacacacacaactgaagaatcacagccaattgctggcaaatggagaaacagctggggaggcattgtcatcttgcttctgtcctaaaatgacctgagggctggggcagtgcaggcagctggcatttcagagccattgggatcctcaggcgacattttctcatcttccggagatggtggctttgaacattaaggcctcattaattctacctcggttccttcccaagtggccatcagcccccgggggacagtggggaatggtcgttccctccctcccactaacaggctgggtctcatccaaggggtggattttcacccaaagcagaaatggcatccccagaggtaagtgtgactcccgctccactcatctggggctttggcagctggtcttgacaggagacagggggatggaccagatgacctcaggcgccaccccaagccctgtctgtgcagtccaagaaggggggtgtccaaggtatgcaggtatgtgcagggagtggatacagtgcccccaagggcttctagcactgtcagcaactctgtggcaggtgctgggagagacacagaagaaaaggagacgccaccctccctccaccttgggagactaatctgatggaggagacaaggcctctgtccttggagagatgatcctgggacagggaaacatggctcctttattcaaggaatagctgctcaaagagaagaggcaatgcctcatccttcatgtcagtaatgagggagatatgacaacccaccctcagtgagctcctagtcagatggaggagacacagtctgcacttggggagaaatttccttctgatggggagacttggtctccaggagacatggccctgttttttgagcattcctagtctgatggggtatccacctttggggtactcctaatctgatggaggagtacaggaccccactttctaggaatttccagtctgatggaatagacatttccctctaacttccagggtccccaacttgattggaaaaactcagcaacaatttagaatttctcaatctgatggaggaaacagggctgccgccttgtaggaattttcaatctgatggaggagacatgctctcaccctcaagaatctttcaatctgatggaggagctatggcttacacattctggggtctctcggtctgacagacacaagtcccaaccatctcatggggaagacatggtccccattttctgggatttccactctgataggggagacatggcccctatattttgggaatttccaatctgatggaggagacatgacccaagcctctagggtcttccagtttgatgggagagacacctctcaaagtctgggaatttgtagtctgataggggaaacacagaccccagcagacactactgggacccagaatccacctccaccaccgcacaagtcacctccttcctcagtctccttcccagcaccctacatggggagtgccagccagctggggggaggccagcaagggttgggaaggggacaccatgccagatgcagaccaaactgacccagcccgctcgctctctccccagctgcagcagttgccacgatgatcgtgcccgtgcccaccaagccaacggagggccaggacgtaacactgaccgtgcagggctaccccaaggacctgctggtctacgcctggtaccgcgggcctgcctccgagcccaaccggctgctcagccagctgccgtcaggaacctggattgcaggccccgcgcacacaggccgggaggtgggcttccccaactgctcgctgttggtgcagaagctgaacctcacagacactggccgctacacactcaagaccgtcacagtgcagggcaagactgagacactggaagtggagctgcaggtggcccgtgagtgtgtgggaaggggcaaggcgtgcccctttttagacaagggctcccaaaaggagcctttgcttcctccatcaggctggggggacatagaccaaagatggatacccatcccccatcaggctgaaggaagcagccttgtctcctccgcctaacttgggggtccccaaatagggttctgcctcttctatcaaactaatgacctacactgtgggtagacaggcctcctccatcagactgagggttgctaaaggggacccccatgccttctctctcaaataagaggtacagcacactgaaggttttaaaagagaaggcatagtctgatggtggagcatcctttttcctgcagacaggtggaccctaaaacatagggtccatattggggtaatgggttaattataggagtttacctctcctatcagactgcaggcagagaataaggatgaatcaggcctccctattcagactgggagatcctgtgcagtggggatcatgtctcctcctttctattattgtgagggcaaagtttctatcatcagatggtggagtttctctttcaaactgaaataaggatgattgctccattaggatggaggcctgtaggtgtggaagttgtgtctcctcacagaatggaagttcccagatgttggggaccatgtctccccatcagactgggagctcttagaagtcaggaacaatgtctcccccattggattgggaattcccaagtgttggagaccatgtcacctccctcagactgggagctctcagatgttgggaaccgtgtctccccatcaactgggagcttctagagtcagaaactatgcctcctccatcagactaggagctcccagagtcaagatccaggtctcctccatcagactgagagctcccagagttatagaccatgtttcctccgtcagactgggagctcccagaggcagagaccacgtctccttcatcagactgggagctcccagaggcatggtccatgtctcctccatcagactgggagctcccggagtcagggactatgtctccctcgtcagactgggaactccaggagtgagggtccatgtctcctccatcagactgggagctcccagagtcagggaccatgtttcctccatcagactgggagctcccagagtcagggaccatgtctcctccatcagactgggagctcccagagtcagggtctatgtctcctccatcagaccgggagctcccagagtcagggaccatgtctccttcatcagactgggagctcccagagtcagggaccatgtctccttcatcagactgggagctcccagagtcagggaccatgtctcctccatcagaccgggagctcccagagtcagggtctatgtctcctccatcagaccgggagctcccagaggcatggtccatgtctcctccatcagactgggagctcccagagtcagggtctatgtctcctccatcagactgggagctcccagagtcagggaccatgtctcctccatcagactgggagctcccagagtcagggaccatgtctcctccatcagactgggagctcccagagtcagggaccatgtctcctccatcagactgggagctcccagagtcagggagcatgtctcctccatcagactgggagctcccagagtcagggaccatgtctcctccatcagactgggagatcccagagtcagggtctatgtctcctccatcagactgggagctcccagagtcagggtccatgtatcctccatctgactgagcatccccagaggtctgagtccatgtccctacagcagggccaggtttcccccattagctctcagacactggggatgagatcattccccaagtctggaatcttgcctcccccagcagacagagcattctcagaagccatgtccctgagtccgggatggtgcctcccctatcactggaaatttccaggatcaaggactcaaccactgccagtcacccactttcatccagtcactgatcaaaccctggttttctgggtcagtgttaggggagaatgctgttcagtggcagcaggccaccccggcaaagccttgggattccttttcacccattctctcttctcacagtcaacctccctccctcgcacaaggaccaacgctaccttcctgaacctgaacctggcacaggctgagcgtggggtggattgggccactgggtggcccggggtgggcaggggagcagaaggggtgggggcactggggacctggtcctccatctctctgacatcctccttcgccccctcgccccatatgccccacagccctggggtaacagcgtgaccctggagacgtccagagagaagagctcttcgcaccatcctctggtcctcgccctctgagtgggaaccactcccccacagcgaggatgccaggctgtggtcctgctgttctcctgcctccaccctagagctagagccacagggccccactccctcgctgagctgttggggagccaccgaggccataaacgtcctggttaatgcacacgtgtgtcagcctctccttccaccaccgctagccccgccatttcctggtggccgcactcatttcctttcccccccaagacttttctcagtctgggtgtgcacgtgcaggaggatgggcccagatcaccgtgctccacaccccactgctggatgccagggccttgtgcccctcccgcagtgctccaggttatatgtgagagtcctgctccccagctggccaaggactgcccctcttggagcaccagcattctgtgggacatggctctcccctacactgcacctcattttgtcacctggccccgaaacagggctgcttgtgctcaggaaatgaccatattttgcaagaagtcttccatcaccttctggtagtcctcacccatttaatcaaagacacaactttgtcctgggattccccgcatgtctctccaacattatctgcccaaccctgacaatatctccttccttctgcagccacaggaaaggccctgtggatggatgaatgcaagcggggcagaggtagaggccaggagtggagagctgggaagtgggggccagaatgagtgtgttttctaactcgtctcattagtgggagccacaggccccacccagccgcaatgccccactggaaacaggttcttggcattggtcaggagtggtgatggccgagtcgaggcttagaatagaaagacaggtttgggcagagacgagaaaggcccttttggggatgattgtgttgagttggggtgatgggtggtgaaagacctccagaatgagggttataaaacctggatcaaaatcctgcatttgccacggattcactagagcctcagtttgcccatcagtaaaaaggtgtggacttgaggtggaccagacttttccaaaccatttttaaaagcctcagagccctttcttcaaatacaagtttacatggcaggtcaatttattattaatatttaaaatagcaatgcaacaaatatagccccagcacagtgcccatgcctgtaatcctaacgctttaggaggctaaggtgagagaaacgcttgagcccagaaatttcagaccagcctgggcaacatggcaaaatcccgtctctatttttgaaaataaataaataaataaaaccaactatagataccaattcaatagctatactcgtctcccccaaaatttctatagaattggaaaaaaaattacttaaatttaaataccactgggattagccagacatggtggcgcatgcctatagatcacttgagcccaggaatttgaggctgcagtgagccatgattgcaccactgcactccagcctgagcaacagagtgagactacgtctcataaaaaatgttaaattttacaaataaaaggtaacacttggggccgggcgcggtggctcacccctgtaattccagcactttgggaggctgaggcaggtagatcacaaggtcaggagtacaagaccagcctgaccaacatggtgaaaccccgtctctactaaaaatacaaaaattatccagccgtggtggcatgctcctgtaatcccagctactcaagaggctgaggcaggagaattgcttgaatctgggaggcagaggttgtaatgagccaagatcgcaccactgcactccagcctgggcaacagagcaagaagactccgtcaaaaaaaaaaaaaaaaaagtaacacttggactacagaagcaactaaaatacaagatatcaaccagaatcaaatgacagtaaaagcatcatatacatcaaacctgtgggacatggccacagccatccttgaagagaaaaatgatagcttataagcattgagagtactaaaggaaaaagacttgaaaatgaataaaacaagctttctactcaagaaactagaaaaagtccacaaaacgaaccaaagaaaaaagctaaggaatgaagaaaggtaaaagcagaaatagatgaaatgtaaaacaaaacatggccaataaaacctaaagctgattctttgaaaatgcaatgaaatagacagactttctgcaggtatgatcaagaaaaaaaaaaaaacagagaagtataaataagaaacacaaataataaagagccaaggagattaatatataaaataaaaggccctggggtgggcgctgcgctcacacctgtaatcccagcactctgggaggctgagccaggaggatcacttgagcccaggagtcccagaccagcctgagcaatgtagcaagacctcatctctacaaaagtttttcaaaaattatccaggaatagtggtgcatgcctgtagtctcagctacatgggaggctaaggcaggaggattgcttgagcccaggaggccaaggttgcagtgagctataatcaccctactgcactccatcctgggcgacagagcaagaccttgtctctaaaaaaagagagagagagagaaaagagaaactggtctggttgaagcaaaggttgctcaataaatatacattgactgaagagggatctgttggttgctccccagcccactgccctccctgcttccatgacacacacactgcctccctctctagaagctgaaaatgtcaggtactcactttcccaaactgccttgcagctgcaagcagccatgtgaccaattcaagcccatgaggaaggagagagcctaaagttccacccactgactccacctcaccggaggggacactgagggagctctatggagtttgaaagctattatctaaattagtggtctccattgtggggcttctagctgggacgtgaggatggacttgagcccatactactaaccccaacactatccagcccagaaagaagaaatagcatccatattaccaccttcaccccacccccatccacccaagttcacataaaaacttgacatagatgtggctagagtctagatataacagttagaaattcttggccgggcgaggttgcttatgcctgtaatcccagcactttgggaggccgaggcgggtggatcacgaggtcagaagttcaagaccatcctggctaacatggtgaaaccccgtctctactaaaaatagaaaaaattagccaggtgcagtggcaggcacctgtagtcccagctactggggaggctgaggcaggagtatggtgcaaacctgggaggcggagtttgcagtgagccgagatcatgccactgcactccagcctgggcgacacagcaagaccccgtctcaaaaaaagaaaaaaaaattagctgggcgtggtggcaggtgcctgtagtcccagctactcgggaggctgaggcaggagaatggcgtgaacctgggaggcagagcttgcagtgagccgagatcacgccactgcactccagcctgggtgacacagcgagactctgtctcgaaaaaaaaaaaaaaaaaaaagaaagaaagaaattctcttcagtggctaggctgggcactgtggctcacacctgtaatcccagcactttgggaggccgaggtgggctgatcatctgaggtcaggagttcgagaccagcctggccaatatggtgaagccccatctctactaaaaatacacaaaaattagccgggcatggtgtgatcaagaaaaaaaaaacagaagtataaataaggaacacaaataataaaaagccaaggagattaatatataagataaaagggcacctgtaatccctgctacttgggaggctgaggcaggagaattgcttgaacccatggggcaggggttgcagtaagctgagatcataccattgcactccagcctgggtaacaagagtgaaactcagtctcaaaaaaaaaaagaaaagaaattatcttcagtggctagtaagaaatattggaactagcataaacaattaggcagaatagatatacagggagtagcttatatggctagaagattatttttctcatttctcaaacataaaaaatctccagaagcagattgttcagagctagaatggaggccctgtagtgtcatcagggacacagctccttctatttttctgttccattatccttaccttggggtttccatcctctccatcacctcatggcccaagatggctgctggagtcacagctgcctcatccatgttccaggcaagaagcagaaagaagggaacaaagggaaacaaacaaaaaaaaactccccctagccagtttatggactgtgccccttttaagggaactttacctaaggcccatccaacaacccctgcttagatctgattggccagctcatagtaccatggccaccctagctgcaagggaggcaggaaattgcagtcattgccttgggtatgttgctgccccaattaacatcaaggttcttgtattaagaaaggcagagagaatgggtcccgggtgggcagctggcaggcttggccactccaagctttggaacttctacctcctcagctaggcaaaatggccttcctcacctgagcccaaggagtaagagtcacagcccccatagcaggggtttgagaaagatgggagctgctgctctgagctgtgattgtgtgcagttgatgcagaatgaggccagcaggaggggcagaaggagggaaggagaagcagctcaggtttctaggtcaagcaaaatcccatagcctcagggtgtggtggaggctcaaatgtccccaagaccaggtcctccgtccctctgggcatctctgtgctcttttactgaattatctcaagtagtgcaatccccttcattaagagtgtaggaaagaataataacaataaccacaaaataataatcactcctatatctcgagcatcagtgtattagtccattctcacattgctataaagacatacctgagactgggtaatttataaagaaaagaggtttaatcagctcatgattctgtgggctatacaggcttctgcttctggggagacctcaggaaacttacaatcatggcagaaggtgaaagggaagcaagcacgtcttcacatggccggcaggagaggcaggtggggtgctacacacttttaaacaagcagcactagggggacggtgctaaaacattagaaactgcccccacgatccaatcacctcccacgaggtccctcctcctacactgaggatcataactggacatgagatttgggtggggactaagaactaaaccatatcaattggttttatcctttttcatgcaagatctcaattcctacagcagctcttaagagcagttactatcattcccccaacttacaggtgaggaaactaaggcacagagacttgaaaactttgctccaagtcccacagttcccatgtgtcctaggtggaggtgctggtgggggagtcctctccattcttcagcagggcagagggtttcagggcacagctctgaggacagacagaactctttttagctgtgggaacttgggtacattgcttgcttttcctcctcgtaaaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggggcgcggaagaggggggggggcgaggggggggtcggtggggagagaacccccgaggggggccccgggcgagcagagtgtcggggaggtgcttgtggcggttgttatgtatgagagcgagcccaacgtgacagttacgagagctggttgggggcgtgtggggacaaagttgttctgtgcacagactgggaggaaccgccaaggtctagtgcactgggggctcggacgctgggcgccaaacaatccgcccgggtggcgctcccaaaagggcgggggccaaaggtgttgccaccctggcccgcagaagttttgtatttacacccacacacacgcgatttatttgccccgacctatatgggtacacacacgccatccctatatagatgcgagagagcgatctctctctctgaaaaaaaaaaaaaaaaaaaaaaaatatatatatatatatatatatatttttttttttttttttttttttttccctgagatggagtcttgccctctcgtccaggctactagagtgcagtagtgcaatcttggctcactgcaacctccacctcccatgtccaagtgattctccagcctcagcatcccgagtagctgggattacagtacctgccaccaggccaactaatgtttgtatttgtgtagagatggggtttcaccatgttggccaggctggtcttgaactctatctagaatatacaatatatcaaacatttcaacacaaaaaaaaaaatctgactttttttttttggagatgtaatctcaatctgtcacccaggctagagtgcagtggcatgatctcagctcactccaacctctgcctcccaggttcaagtgattctcctgcctcagcctcctgagtagttggaactacaggcttgtaccaccacgcccagctaatttttgtatttttagtagagtcggggtttcaccgtgttggccaggctggtttcaaattcctgacctcaagtgatcgacccgcatcggcctcccgaagtgctgggattataggtgtgagccatcacgactggccattttttgtctttttgatgacatcttgctctgtcatccaggctgagtgcagtggcgcaactatagctcactgcagcctccaattcctgggttcaagcaatcctcccacatcagcctcccaagtgagtagctgggaccaccactgtgcaccaccacacctggctgtttttaactttttgtgcagacagggtctcgctgtattgctcaggctggtctcgaactcctggcttcaagcaaccctcctacctctgcttcctaaagtgccaggattataggtgtaagccaccatggctggccaacaat

SEQ ID NO: 190 - DNA, 1559 bp, Homo sapiens
gtcctgcggcagacggagccgagccccaaccaggaagggagtccgagcactgggacttcaacgccaccatctccaagactcggtttggggtgaaagatggcgctgactggccacattcctgaatgtgggggccgagatctctatcaccctggagcctgcccagccgagcgaaggggacaacgtcacgctggtcgtccatgggctttcgggggaactgctcgcctacagctggtatgcggggcccacactcagcgtgtcatacctggtggccagctacatcgtgagcacaggcgatgagactcctggcccggcccacacggggcgggaggctgtgcgccccgatggcagcctggacatccagggcatcctgccccggcactcaggcacctacatcctgcagaccttcaacaggcagttgcagaccgaggtgggctacggacacgtgcaggtccatgagatcctggcccagcccacagtcttggccaacagcacagcgctggtggaacgtcgagacaccctgcgccttatgtgcagcagccccagccccaccgccgaggtccgctggttcttcaacggtggggccctgcccgtcgctctccgcctgggcctgtcccctgacggccgggtgctggccaggcatggcatccgccgggaggaggccggcgcctatcagtgtgaggtgtggaacccggtcagtgtcagccgcagcgagcccatcaacctgaccgtgtactttggcccagagcgtgtggccatcctccaggattccaccacccgcacaggctgcaccatcaaagttgacttcaacacgtccctcaccctgtggtgcgtgtccaggtcctgcccagagcccgagtatgtgtggaccttcaacgggcaggccctaaagaacggccaagaccacctcaacatcagcagcatgacagccgcccaggaggggacgtacacatgtattgcgaagaacaccaagaccctgctatctggatctgcctcagtcgtggtcaagctctctgctgcagcagttgccacgatgatcgtgcccgtgcccaccaagccaacggagggccaggacgtaacactgaccgtgcagggctaccccaaggacctgctggtctacgcctggtaccgcgggcctgcctccgagcccaaccggctgctcagccagctgccgtcaggaacctggattgcaggccccgcgcacacaggccgggaggtgggcttccccaactgctcgctgttggtgcagaagctgaacctcacagacactggccgctacacactcaagaccgtcacagtgcagggcaagactgagacactggaagtggagctgcaggtggcccccctggggtaacagcgtgaccctggagacgtccagagagaagagctcttcgcaccatcctctggtcctcgccctctgagtgggaaccactcccccacagcgaggatgccaggctgtggtcctgctgttctcctgcctccaccctagagctagagccacagggccccactccctcgctgagctgttggggagccaccgaggccataaacgtcctggttaa

SEQ ID NO: 191 - protein, 412 aa, Homo sapiens
LATFLNVGAEISITLEPAQPSEGDNVTLVVHGLSGELLAYSWYAGPTLSVSYLVASYIVSTGDETPGPAHTGREAVRPDGSLDIQGILPRHSGTYILQTFNRQLQTEVGYGHVQVHEILAQPTVLANSTALVERRDTLRLMCSSPSPTAEVRWFFNGGALPVRLGLSPDGRVLARHGIRREEAGAYQCEVWNPVSVSRSEPINLTVYFGPERVAILQDSTTRTGCTIKVDFNTSLTLWCVSRSCPEPEYVWTFNGQALKNGQDHLNISSMTAAQEGTYTCIAKNTKTLLSGSASVVVKLSAAAVATMIVPVPTKPTEGQDVTLTVQGYPKDLLVYAWYRGPASEPNRLLSQLPSGTWIAGPAHTGREVGFPNCSLLVQKLNLTDTGRYTLKTVTVQGKTETLEVELQVAPLG

SEQ ID NO: 192 - DNA, 240102 bp, Mus musculus
  misc_feature (1)...(240102): n = A,T,C or G
aaacaaaacaaaacaatttacccaaccattcccatgtactggctccatgtttaagcaaatctgggttgtgtttccttgtacaggcttaaaaataattagtatgtttgacattttccagaattcgagccaagatacatggtcagactctagaaagatctgaaacacagagtttgtaatgtcaactgcccccccccatcatttccgctgagctgtcctgtcccttcctctgagcgagaaactggatctgctgtcagcatccttttcagatttcacagaccccacagaacaaggtggggactggtgccttttgctctgcagtccagatatcagaactggggttcacagacaattgaaagataacgatggcagtcttgccatcggcttcagtacctctctctctctctttctctttctctctctctctctctctctctctctctctccctccctccctccctctccctctctccgtccctctccctctctctnnnnnnnnnnnnnnnnnnnntccctccctccctccctccttccctcccatcctctctctttctctctctctctctctctctctctttctttttattttgctacagtagtgagggttgacagagctccttaacacagttagtggtaaatgaagatttcaataatgactcacagggaaaaattacacccttgctctccatgtatacttcatgagaacttttggcaaaggtgcctctcaaaattaatcccacagcagtctccttccaccctcttcccttcctctcttcagcagttctcccacgggtccctgctcctccttgagggctttgccttggatgattagaggcaatgctgtggatccaaggcttacactgagccttttcttcctcaacttagcaatactttctccttttctcagatgaaaatttaaaaagaagcaatctcaaatgtggtttggatgctgtcccatttttcccccaagttaagaaggagctggtcatacatttggatgctgacataataaatattccgaagattctaagcctgtgtcttctacagaatactcagttttactctgacattaaatttttgaaacagttgggttttttatttaagatttattttatttatatgagtgcactgtagctgtacagatggttgggatccatcatgtggttgttgggaattgaactcaggacctctgttcactctggacctgcttgctccagccccaaaatttatttattattatattatgtaagtacactgtagctgtcttcagacacaccagaagagggcatcagctccctttacagatggttgtgagccaccatgtggttgctgggaattgaactcaggacctttgcaagagcagtcagtgctcttagccactaagccatctccagctagcccttgaaacagttttatggctttaaaatgtcggtctacaattcctttcattaattcttcttcagagtcatgcattgaaacaccttttagctaaaagaacctgtttagacaaactgtgcctataaacattaatttctgcaagaaatatgaccaaagtctaattagaatgcctgtagaccacagttacctaatcccagcacctgatataacaaacaaaagcaaaaacctaaagaggagaggagcttcgagctatggttaccttctctaaagttcaaggtgcattttagcactttaaagggctctgggcatcctaaaaatcaagacgttagtttaagttatttaattgtttttcaaacatttggttacagagcacttctagtacgcattgactacctatgaaaattcttgataaactgaattcctttgtacacacttttggaaattttgctggaaaatgttagaccatgtatgaagatatgatatggaagtattagtaagagagtttagaagacagagacctcatgggagggtataggggagaaagaggatggtagagggatctgggaaaaacatgtcaaacacacatgatatacttgcaagaaaacttgcaaaataaatttaacatattttcttctctaatgcatcagaaaataaccttgatgtggaaatgtaactgagttcactctacatccatccttttacaggatatgatagtcaactaactgtattcacctgcctgggtagggagatacccagagaacaggtaaaacattgttttggggtttgtttgcaagactgtttctggaaaaaattcacattggcatttaccagcaagtcaggtaaataatgcccttcctcagcaatacgggtggatgcgtttaaaccactaaagtggaaatgtttccagaggcacagccttgtgctctcttcttgagctcgagtgttgtgttaaatatttaatctcagctgttggtggtggtggtgggctctattccacctttagttattcggttcccagagaaatgacaggaaacttttataattacaataagccttagtcagcactagagctgggcagatatttaccctctaagctgttagcatctatttccccattaataactccccagttataacttgccatgttccgtctgggtagctcttaactcctactgaccagttaggttttcatggattcacctattccggggcagcttcctcctctctcaaccttcttcctctcctctcttcttgctgtctcccactccaagcctgggaaccaaaccacccccaccccatcccaccccaaccccccacaacctcatccctgcctttcttctgcccagctataggatattggcatctttattcaccaatcaggaatatttttgtggtcaaggttacagagcatcacttgggtctacctgcagactactttcttatccctggtagcaaccaagccttgaaggctagtatttaacattacaacacataacaaaagaccaaacctcaacactggaatgtttaccttctcctgtccctggacatcagagctgcagtttcctcagtttcttaagcctccagactctcatacttaacagtccatgttagtctcaggcctatagactcaggattatatactagctatgaaggatctctagtcttcagaaggctgtctgtgggatttctgggattgtatcactttacgacacaataacaaattcatatatatgtgcaggagggtatgtatgtatgtatgtatgtatgtatgtatctatctatctatctatctatctatctatctatctatctatctatctattctgttgactgtgtctctttagtactctgacacacaaagacatttacagttcatttctagaatgctagttaagtctccaagtgcctactgggttcttataacataacacattcctgcttacttgtggtattgtgtttattggcttctgaatagctttgggtccagtgttggggaatagcagttacagacagtgacttctactgataattttctttttttccttttattgaaaatagattcttttctcagatgatatatcttgaatatatgtaggtgcttccccccccccattctcctcccagttccttcccaccttctaacactagtctccctttggcacctcctctgtaccctcctctgcttgaactctcctgatgtgtttagccagcccctcttcctgacattctgatttgctcttcccagggctccaggcttggaactcccagttccttctcgctaatccacatacagagacacacatactttataccacgtgacaattactaatgcatttttatggccccttttttctcttcccacacatttttctcatataaacacatggttttaagaagtgtgactttgagttttgttttgaatttagacattcttttcttttttttttataaaagtagaggtcttttcatacaaaatattttcattaaactccccatcccccaactcttcccaaatcctccttactttcctcccaaattctccctacttcccttcccacccaaatccacccccttctttcttgctttttaatcctacccacagagtcaagtattaaaagctacgattgatatttcaactgataattcagctttcagttttcatagctacatttactttaactagaataaatcacacatgggacaggcgatgttgattgacagctagattagtctgtttgctggggacaagttgtgtacctaatgaatatgaatctgatgctttgtttatatgtttgtttagtcatccagggtgctgtttacatacatgatatattcctacatacccaaagcctgtccacctcagggataggaaacactgtgctgttcggttactcatcaaagtctctagcatttctctgccattaaagagaacccagtgaatatgtcttgagtgtaatttatacaggggtctggctatctttggaatttaccatccccttagcttcaatatttgtcagtgttgagtgtttacaatggttccaaatgccagcaattccaagtgagacccgtgactctctgcagctgactctgggtggggcttcctctgagcacatgtcctccattctataggacaagcccactttaatcctttcagtatccttcccctgcatggtgccatctgcaaatgggatgcgtatcttttacatactgggcacatgtctttgggaggggccagggttttgcttaattcttaccataccaacgaaaactctagtccttcttctctgactcaagagtatgctgggatacaatcaagaatagattaatgctaaatttgagtgggctcttaaccacctttaaaaaaaagatagtttactttccagtttgagagttttattatcaaaatcttactaaggaattcacctgtggaatattgggttggtatctgttatgctagttggcagcctctggcaaagtgaacacaaagtcatcgtgagtggctgagcttccaataaaagcactggttttctacaggagatgaaggcagtttctaagcagcatgggaaactcctaccatcacagatgatgccccactgagactacactggtagcatctccagaaaacctatggcaatctcgacacctttggatttctacagtgaccgaatgagctagctagccaataatgagtcaggcaaagacaacaacccaaatggggcacaatgacaatgcctgtgatccctgtgtacaagaatgcggaggcaggaggatagaccttgtatccaaaagaatttttaaaagaaaataagaggatgaggatggaagagggtggtggggagaaatagaggagagaaagaggacaggaaggaaggaaagaaaagaagaaaaaaagaaggaaagaaagaatgaaagaacaaaaggaaaggaaggaaggaaggaagagagagagagagaaagagagagaggaaaagcaaggaaggaagggagggagggagggagggagggaggggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaatcctgtttcttttgctaatgttctcggcctcgctccaccttctccaaatagagagaacgaactgcggataaaaatgcacgcatcgcagccttagctcctcaaccacatttgggagaggcctgcggggtcgggtgactcaagctcgcgcggggacgagacgagccgagagcgctcccgacttccctggaaccttaacgtcctacggttcaccttctcccgattgtggggccctctccctgacccagatcactccccaacttggttcccagaccccatcgggagcccggctccccttagcccaagaagccgcacctgtgggctctgggtcgcctcccgctgcgctcgggcgcagctccccgaggctccgctaggggtctctgtcgggtggcgagccgggtgggcgggatcagctgactctgccggctgcgagccccgccgcctcgctccagctctgtcagtttcctcggcggcgggaggcgagagcaccgggagcagagcgagcgcggggccaccggagacggcggcggcggcggcggcggcgcggacacagccagggcgcggcggatcttccactcgcacacggagcactcggtggcccacgcaggatcacgatgctgcccagcttggcactgctcctgctggccgcctggacggttcgggctctggaggtgggtgccgcgccttgggaacgagactggggaggcgggcgccgggaggacgcgatcctccccaccgaggagcttgaatctcgagacgtggggggctgtcacgggtagaccgctcctcgccgcccccgcctgcgggcgccctgcgcttcggcggctctggcccaaccctgcccggggacgcgctgcccgagcgatgaagagggaatgggttagggcgctggggtccccatatccgtgccagcctagggctggaaggcgaggggacgagcctgaacgcagaccctgactcctccctgcgttgagagctggactccgggatgcgagagacacccagttcgagggggaagggacacgtgtggaaaaccgaaagcgtagcgtctcaggattcagtgccctgcgaggaaatcgccgcccttccccttccttggggtcctgggttggaatgggggcagctctggatgctggggagcgcctggctcacactcccttcccacccccgcctgtcttgactgcgaagctgggctttgctcctggcggccgcgggcggcggctgcctgcgcagcgaccctctcccgagtcggtgcggggtcgcgcaccgccgccttccttttgcaaactttgtgcattttcgtgtctcccttttgtgtaagttccaagtgatgggagggatcggaaagtgcggccacccggcaccgtccctcaacctggacgtccaggactcttcagtgcacctccagtttctccctgagtctgagaaggtccccgggaacaaaagccgcgacaccccgccctcgccgtccagggcgcggtggcggagccctggtagttggtgcgccaccgccgttcctttccccgagctgcgcgtctgcccccgagggcctagaggtgctgctagggccccgcggtctcccacccccgcatcaccaccacctactggcaatcctgtgagggactgcaaagtcctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcgaagctgacattctttttttgacagggatccatcgggagtcaccggttactgcttgtcagtgggaagccatgatactggcagactataaatgcttctttcttatcacccccaagggatagcgtccctcattacacttgtaaggctgcaagcaattaaaagatggaaccgaggaaatgaaaaggtatatacaggatcacaaaactaaactggaaaattcaagatttaagattaaataggagaaaaataggatcaatgggctactggtttgaaggaaggtgaagttacttttacggctaaggtttttaagtttttagtttactgtttatgacacgccaattttctatatctctgtgttaaagattatctatcagtcatcctgcatatagacgtgaagaaggtgcttaataaaatattatgcgttatttttgcagaggtgttgtcgtgggatttacagggcatctttgactaatacatttcttttctaatctctgccttttatgtcaagatggacctgcacaaacatactttaaatatcaagctcatgtttacttgactgtatatattttattgccttctcccacactgggtacagaagtatgcagggtgaataaagcaggcacataattataaaataggagtgttgcgtaccaaaaaagaaagtacagattaggcaaagaaaaaaaaaaaagaaaggacacagaaagtggggtactcagaaagtgtagcaggataaagacctagaattaaaaagagtaaaggaacaagagaacaggataatcctgggatgtttcctgggtgaaagtctccagccaggtttgagtcctgggtctgtgaatggaggttaagtatttgcatggattgtatttgctcacgcacagacactagagcctacgtgcaaggcctttgtcttatctgtcttccctgctctcgatttccagccaggcacagataaggttttacataatgaaggcgagaacaagtgtggagttccatttgattcgtggcctcgtctgttcatttgggacaatttgattgattgatttttaggccaaatcgtgtctctcagctctgatcacctttatgtaaaccccaaccgtctctcccctcatggagcttccactcatccaggcaagacaggaaataaacagaaactgtggcaggtgtaggccagactctggagctgggtgaagaactggaagaaggagaccaaggctgaaagcagcctgggaagtatccctagcaccatcttgaccaggggaggtaaggacaaaaagcttcacccaccatgcaaacttccaggagggaagggagaagcaaattttcaaagtgcttccataaggaacgttagccaagagttgtcatcctcctttacacatcagggtcacagagtgtctctgccttcctccctccctccctccctccctcccttccttcccccctctctcccttccttcctgtgtttgtgtatgtgatgttgggatttcatatggagacttaggcatgatggacaaatgcctgctgcactacatccccatcccaaggaatcatgaagatgaaaacaaaaccagaagcagaaaagttccagagtgttgtcagagttccacccagtacatcagaaagagaatcccggaagcaaggcctggacattggcattaagggaagaaaaaaacaaaaaattctccgggcaattttaaaatagaaactgtgatttttgagggcagttacagatggaccaatttgaaccacattcaggattcatcaagctgttctgaaaccaaacgagccaagtaatggcatggaagctagtagctgtgcaggaaaacagggaggagggcagaggaaagctcgggtctgtttgcagcctcgtcatctctccttaaggctgctgtggcttgacattacctctctgtagccaggactgcagtcacattccaccccctgggctagatgaccttgtggccttttgggaaacttgcctcacagagcacacacctgcgtttgtgaaggcctggcaggcagccagcacgctcagctcccaagccctaacctggttattattttttttttctttctgttcttgtttgtttcttgatgcaactgtgacatcttttccttctcatagtgggatcctagatacaaaccgtggagtgcagagtgataatcaatactgtctgatgcaagagctcctgagtgctgtaacctcctgcatcttaccttccgtgacctaccctcatgagtgcgtgggaaagaggacaggctaaggtgggggagtgagcatgctccctggatgagtagcaaggataagcaactatacatattatatttcagtcacagtttgcccatggaggtattattccaggagagatgttacatagctctttccttaacatggattgcttttgagagagacgaatatttattatgaaaaaaaatgttgggtgaattttcttttcttcagattgttctacctaggaggtttgactggtaccatctttgggacaggaaatgctcccaagaatgctggattagaatgactgctgtagtaatttatttaaaatgaggttttgtttgtttgtttgtttgttttttgtttttttttgctactagttttaaagaaagcattcatcaagaaatagctataaaagagattacggggaacttgggttcacatacattcagtcctagcttcagtactgggtaaagaagatattttatttacatttatttatatggaaactgtttttattttttgagatggggatctgttttgattactttttgttaacttgacagagactaaagtcacctgggaagagggaccctcaagtgagaattgcctttatcagattggcctgcaggggtggggcattctcttgatttatgattattgtgggttggcctagacaactatgggcggggccacccctgagcaggtagtccttggatgtataagaaagcaggctgagccaaccctggagacagccagccagcaaacaccccttctgttttagttcctgcctctggtccctatttgagctcatatccttggctgtccttgatggactgtaacgtgtaagatgtaataaaccctttcctcccaggttactcttggccataccttaaatattgtattatcattttaaaattatgtctatatgtgtggctatgtgcacatgagtacagttacctgtggagaatacaggccttggatctcccggaagttagaatttacaggtgtctgtgaatcaactgaattggaagaaccaaagtgctcttagtcccctcagcccctaagaagacagaactggagtgaacatttgtaatactgattttgatgtcaggtgtattgttaggtcagtaatttgaaccattgagtgtttctcagatgtctagaaaaggccagcatttcacattgctttctgttgctgtgacacaatacctgagacagccaacttaaaaagaagaaaggtttatcttggtttacagtttgggaggtttaagtctatgattggttggccccataattatgggcctgttgtgaggcagcatattatggccagctgttcctgtcatggtggtctgcctggaagcaaacaggagaaaagaagagaccaacttgtcagattcccacacaatccccacctttaacgacaggggccttcagaaggctaagcctttgacccactggcctttgggtcatacttatgatttaagctataacaaacatggatccagaaaccaaatgggggcaaggttgcttgagcatgtgctcaggataatgtgtaccctgagatactggccatgggtaaatttctgtgcttctgtaaaatgtagctagtagtatttaatgttgtcaaggattaatttaatatataaggtccttacaagtagataaatcgatatgtattaatatgtacttgatgtatgatcgtaactaggtgtcgctacttttataggagggtagaaaattaatgtttttctcacgcatagttacagaaatctaaataatcttcatgatatttcacttattagaataattgactcacttagtgtctaattatgagtaagaagaacttggcagtttgttttctgtaaggttgaatgaatttacccaagcatggcttagacctgtaatcccagcactataggagacatgagtggaggatcacaggttcaaggtcagattgggctatgtgaaaaaaaaaaaagatttaaatacagcacaggtaaaaggggtttggtttctggttttgtttgttttttgtttgtaaaatatcatttatgtgattttctatttcagttggatttttagaaattttagaatgattcgtgttcactgaaaaaaattaaacagtagagaagtgtgcagggtttgtacaaatagagaatgttcattttttaatgctgtgcataccagcagttttccatgtgtttaatattaaaccagtttatgcgctggcttgattattaacacaattatttattagttagacatcttcgggtttgtgtgaggacctggggacaggcttagttttgtcttcagctaaaccttttcaataaaaatgaataatcaggctttgtcatcagaacagatatagaagaatcaaatgccagccaaagaatgttggtcctagtgtagacggctgtaacagcttcactcaagacagggcatgaaggcagccttcctgtaaggaaatcagactcaaaataaaatgagtttatataactgttgtgctaggctctcaggtcttttacctacatctcagttaaaaatacacgcagaaaacaccagcagggttgctcatgtgccattttctctctgtgtgtcaaaattagtctaatgatatctgaaacttttagtaatgatattttaatgatatttaaaacttaggactctgtgattaaattctggttgcaaacagcacggaaggatcaagaagcaaaggccttagggttccaagtgggtttttgttaaccagccgtgtatttatttagtatttggatggaggtcggttttggtctggctgggagtacagaatccatttttaggactcaccctactcagggatgttacacggaggaaggccagatggtctcagggccccgagtgcagggccagtgaacccacatgagaaatgaggaaagggaacacattagagatgcttttgtagaccgtgggtcctgaacctagtacagcaatgggcacggaacaggacaggagtcccctcattttcagatggcctgggttttttttcctctccagttcaaaagatatttcaggttaaaaatttcgctcagaaacaataaaaaatttactttgtttttggtgatttcccagttatgaagctgttctttgtctgatgtttttcccccctcagggaatcaaatttgtactatgtcctcggtttctagagagccacatactgtctttatcttcaccgaaaacagtggggctttctaaatgatagtgacaaattactcttcccgcctctctggacacttaggagagtaagagatccgtcatggaaagtcatttgtgttaagtgaagaaatgctttatcgttcctgtcgccttgctaaatttcaaagctttaatgacactcatatatcttcgccccacagagacatttttgcaggacaataaacatgaggtttaatcttaccctggaggtatgtttgtgtgttttaagatgtgccctttcaggcctggttaccaaaaatctcatttgttcagctttgctttgtctgcacaatcttctgtttgacattaattaaatttaaaattaatgttttataaatacattccttagttatttaaaaattatagctggataagtttcaatgtgtatatttactgtgcacaggcctctgctgcatgaggacattttcatgcaagtatatgctgtatgctgaggatactctcccctgccctgccctgccctgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgtgtgcctcatttgttcctctactcaggggaacaaaaccccactgcatttcatttttaaaagaaaatagaatgttattatctctcaagactttgtggttaatcctagtatgttccagttattgaatgaagtttcaaaagcataattactttttttttttacaaatgtatcaataacttaagttgtagagtatgatttatacacaaaagttaccatggtaaataagcaccatttctcagcccaatggagtttttaaagcatttgaaaatgtccatcttttttttttttaaagtgatacaacgtttttgaaatctcagcttagcattttggagagtgatactacaatttaccatatgaaacatcacattttatagcaaatattccccattctgatagttaatcgcttgtcatagcatgcttgtaacaagtataattttaccgccacaatatattaatttgagatgaaaagttcttcagacactccaatagaaatgaaaagttcaaatacgaagattaattttaagaatatttaattcttagatacttgtctgttaagtaaaccacatttaatattaaaatctaatttcttcagagaagttactggctaatttttcttacctggtgcattagttacatttttgttgctgtgacaaaatactggacgaaggcaacttaagaaagggaagaccccccccccaattcccacccctccacttcccacccccaccccctagtgctgggtattgaacccagggtcagggtcatgcatattagacatgaaggcaaatgctcttcaaactgagtgtcaaactcagttttatatcggctcacaggttgagggtacaaacaaagcctcatgactcataaagtcagggtcctggggacacaagactgctgatctgcttgcacccatagtcaggaaagcaggagatgaaggccggtgctcatctggcctttttttttttcctgtcaccgtggcatggcaaccattcactgctaccacccacttgagaatgggtcttccttcctcttttacactccctggaagcacacacatagacacacccagagttatacttcccgatcactctagatcctgtcaagtagacgtggagattaaccgtcacttgcagagaagcctggattcagactgggatatttagacaaggagaatcagctttttccttgttccccaggaagcagcaggtggtcagttgaataaacgtgggggtaagagctaaaggagaattctacatggaagtgtgctgtgtgctaatattttaggtaatatatatatatattaccaatatactcttgtatatattaccatgcatatatatacatacatatgtgtgtgtgtgtgtgtgtgtgtcaggtagtgtgtatcactaccctgaggtaaactgaggtatctgaactattcacagtaacatgaaagaacaactgtgaactggggtctgctttgaggcagttaaatattacaaatgaaagtggaactaggagaatactaggaatattaatctttgtgtcactagggacaataccttgaatccagatttatccagtacttgataaatacttttggtgagcactgtagaaattctacagtgcattgatcaagggttgcatggtttggtgcatggtagacggtttagcagggagagtgatttctgttcaagctggatctgagtgtccatgcccagaacccatgtgaaagcatggcacataactgtgacccccatgctggaagggtaggagaattctggagatgtactggccagcagaaatgggagctacggggtcagcgagtgaccctgcctcaaaaataatgaggacatgatagaagaacatcactgccacctgacattgatctctgatctctacacaagcatacaggggtttgttctctctctctctctctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagaaggagaaggagaaggagaagaagaagaagaagaagaagaagaagaagaagaagaagaagaagaagaagaagaagaagaagaagaagaagaaaagaagaagaagaaagaaaactgtactttccaacagctgaaagccagcactactttatgccattccaaagccagcactactttatgccattctattgacaggcattaaaaatcttgctgaggtcattatctttctcctgtttgctcaggcttgatttttaatgttttatgtcaagtgttaaatcattctacaccaaagggttcaggaaatttaagtttgctagaagtaagctgaattttaagataatgtagttgtgttgggtggggaagtttctggaacaaccaataaaaactttttttctctcttttttttttgagattgttttactatgtagttctgactgttctggataggactcctatctatctatctatctatctatctatctatctatctatctatctatctatctatctatccatacatacatacatacatatataccagtctggtttcaaaggcacagagatcagcctgcctttgcctcctgagtgctgggattaaaggcatgttccactacaacccagcctaataaaatctcttgatgtgaaagtagcttacatcttgctgttaatagacgaactgcaaagggccctacttacaggactatattggtaatactatagtgttatttagtgaaagatgagaggcaggaatccctgagggaagccaaagcaatttcagtatggcttaaatagttgaagggaagcttgcaggatggacagagatgtgcctaccactgagtagtttattaacatggctgtcagaaacgtccaggaccaagataatgaaggatgagggttcctagagggtatatgaagtttatttatttactttgcagatgctcctctgtttttagtatatttttaccagttgttggggaatttcatacctgactacaatgtttttagtttttgttttttttaatcatattcaccatgtcttcctctcctaacttctcccagatctacacccccttctttcccacccctcccaactttatgtcctctttatagcaataaaaacaccaagtacactttgggccagccctatactcatggatgtggggccatcccctggaatgtcatctgcctgctaggggccactcccttaaagaaaacaaactctccctcctccagaagccatctactgtcaataactcttcagccaggaatggggatcaccgcccctccccctccagtactggaatgtcgactggcttgatcatgtgcacttcttttacaagcattcatgcctgctatgtgttaaggttgcaccaggcctgccatgtttagagggcaccatttaactttggtccttcaaaacccctggctattaaaacccttttgatccccttctgtagttggtcccaagccttggcatgagtgaagatgatagggatattctatttgtggcagaacactattctgggattttaatatagactgggggatcagattcctctgttcctttgtatttgtgttgcattgttgagcttttatgaactgggctcagaggttctttcgtgaacttctgagggtcatgttggaaggacacagatgacaagagttcagtgggttgacagtatttctcctatgtgtgtgtgtttttagttgtatttattgacttcataaataactgataagatgaggaaaatgtcattaccaacctccttcctggagaagaacagacattcgataaaatatccaagggtttattgtcacatattaaaatgtttgcaattttgaagtaatggcgtgttgactcattgctcattggctcattcatatcagagtttgaatatatacaatccagtcccaagtccctgattctgttgtcagccatggagctggggtaaatgctgaaattttaacgggattttagggtttggggtgtcacatggttctatacctacttcacaatctcttagggaatttgagcatttcattgatgctgatagtgatcggaagttatgatgtttttataactaatttactgcacattgcttttccttctttgatcacatttttaaaaagttaattcctgagcatgtacaagatggcttatgtttcaacaggagcccattctgtcatctctgtgatgctgtatatggagaggtagttcctgctgtaccttgtcaatttcacagtctaatgtagaaggaaaatgcaggaaaataattacgcatactatgtcaaaggctacaataaaagcctatgtaaactcttcacagatatggctgagagcctttgggcaggacttcaagggtaaatggaagttggtcagagcagagtggggttcctagagatgaagaacacacagccagggggtaaagggttaaaagtagaagccttagcatctgtgggatgggatgcgggtgtgtgtggaggggtaactgggaagggggatattatttgaaatgtagacaaataaaataattaataaaaaaagtagaagctgttgttatgtggatatgagactcagggtttcagaagcccttgatgaatctgaacttcattttctgaacaacagtgcacttttacatgttctagaaacagcagtggtcactgataactataattcatctagatttaggagctttaatgaaagatcttgttaatgtctgcttaagcttgtcattaagcttgtcacacctagctgcaagggaatcaggtaaatgtgttttattagccaagtattctgtagccaggaaagccatttcaggatctatcattagggttattatttgttttgatttgatttatttaaaatagggcctccctatgtagtattggctaccccggaactcattatgtagactattctcgtcttcaactcacagaaatccttttgcctctgcttcccacgttctgcacttaaaggcatgcaccaccatgcccaacaggctctattcttaaggacagaggagtcaaatacttggcaacaggctaacattctgtattgtaaaggtaggagaggaaaatgagatgaccaatacatgttctccattaacgcattattcttcctgagcaattagagggcagttttggaatgttcctcccacctttcttacctgctggctgaccacatggaaaatatttgtgggatgatggaagaggaggtggggaatgcttctcgtctgtatgtgaaatcgcccaagagtcaagctcattggactcagagtgtgttcagatgcctggggaatacttccaacgaaaatactgaggggttgggggggtgggggtgggggaggagtaatttcaggttctggaaagaaatgacagcatcagtttcctttccccattggtaaacttttatttcatcnnnnnnnnnnnnnnnnnnnnttgtacttttactttgaaaggactagcaggcgaaatgggctttgaggcttttagaaaggagcacagtatttaggacctcgtctgagccagatctgcccattatataaaatcacttttctgccacgacagagctttttcacatctgtttatacttagtctctcttacccagagtggaaagatttatgtaaaaggagaaaagaactctgaatgtatgtctcgcatcagtgaaagcggggcctccggcttaacatccatttgaagtacgtagctactgtctaatcatttcagttattgtagaagtagccaaatgaagctatgtccctggaaattagagatgaagatgtggggaaaacctacaggtctaagaaggcttgacaagatcatcaacattagggagcgtgtgaagggtctgccatagacatttggaatgcaggcaaaggtttcatttaaaatgtctcaatgattcgtgacatactgcacctggatctgtataataataaatgtctatcatggttcctcaatagtttctcttcgttttattttctaagttagttgcagtttttccttctcttaagtgcagacgaaagccataggaacccgtctaaagacgtatttagggcacacacacacacacacacacacacactatatctagatagatagatagatagatagatagatagatagatagatagatagatagatagatagatagatagattagatagatataaagtggaaatagaagttccaagtccactgtgaggagccagggatggcactgttccatgtaagtgttccctggagacatttgatctctacagttgtctggcctggccctcttagactgcactgtccaataaaactattgtagaactgtttaaatccaatttgaaatttcaaatagccacataaaaatgtaaaagaagataaagtcagaggtagagtgcaagtttagcatttataatactctgggttctatcaccagcacagactatcagatgataaatgatagatgatagatgatagatagatagatgatagatagatagatagatagatagatagatattcattcctttttagtaagttcaaatagtctttgaacatgtaatccacataaagctaattacaaaataaatatattacatggatttttatatcatgtctttaaagttttatctgttgtgcatattttaattcagatcagtcataagtagctgccatattggacagtggagccttacaagactgacccttcccgctgccttccaaaacaggttcacatttagaggatggactctgccaacactgcctaagccccttcattttacaggtgaagatgaccagatctagagatgctgggttgcttagaatcccatggccattcacatcagaagccccacccttttgtctgacttcaattgctttcatcattctttctttccttagatttgtgttgctgcaactactcactgtgagactgttgctgttggttaaatattgagccaggagtcttaaaaacatttggtccactcagtaaagccactgtttgatttggtggaaactgttttgagcagagtaggtagaactaccaggcacattgacagttctccatgagatagtaataggaggtgataatggggacaggggtgactttatgcttgttggtgttgctgtgggcattataggagtatgtgacttcaaattttgaaatgctagctgcctgcttacaggaagggagatgagctgttcccatgcaaagtttattgtctagttgtatgtataagcctacacatgatgaatatcttaatgcttaactctctctggaaatggcagggttaagcttttatatttcatatttttttcttgtgttaggaacgtgtgtgtgtgtgtgtgtgtgtgtgtgtgtgtatgtgtgtgtgtgtgaatgtactcctatttctcactcagttatacttaaagtgtgatgatttttgacaagttaatcccagtacactcctggcatgtaaagtattttcagaatgtaagcccatgtggaaattcgttggcttggtatgacgggttcgggcaggggaggcatagtgtgatcccgtggagtgttcggagctgccaagtatttgttcttcggtgtgaaagcgtgcttgacgggtggactttcctagctggaaggtgctttgttcatccttcctaaaacatttatcagcacggatgttgtagatcgtgtaagagagtcccctttattcatgtgacttagttcagtgatcttagatttagagttaagtttttgtgttccagggttgggactaattcccagccatggcccagctttacccacaaaggaactaccgacctgtaaggatattcatttgatgcgtttgcttttgttcctggtgccagtcattggattttgcctatagtgctttatgtggctatacttagaagttttatagcttgtagcaatcaggtgaaagtacagggatatggctgagtactgtaacttgcgtctgtaatcccagccagaggcaggaggatcaccagtccagggcaatttgagctacagaggcaaactgaaaaaggaaaagaaaaaaaaaaaaagagattcctttatttcctttggccttcatacacaaatatttaaattcttaatgtacggttttaagtcagccccctacctcccccaccttggtagtttgcatagtacacattagcatttgaaacaaaagttttgagctataagatgctcatgggagtcattctgaaatatgtttaaggtggattgattcggaaaggatgcaaatccaagttaggctggctgaggcctccccgcttctttagagggtgatacggaaggtttgaggacccagtctgcttcggtcggagtgtggacagccagtgagggcagtgcagcaaaaccgtgtctcagaatcagaaagttaaaaaaaaaaaaagagggcagaggttatagtggagagacagggcatttgcttagcattcgtgaggccttccatttaagatctctagtaccctgggagaataaaaaatagtcgtaagttcattgtgggaaagtgagaaaaagtgtataagtgcttgtgttctatccacgattgcttttgttgttgttgttgttgttacatcatatttaaaagcatttttgtaattatgccatagattccatttcatatctggtttgttctttttatggttaaattccatccctcataaattctttgtaattataacatttaaagggtgcattcatttgtttaaagcaaccagagctactcacttgtacgtgtggggctttgctttgtttgtttgcttgttagttatttaatattttaacagagggggacgtctatgtgctaagtaagtggtgatactcatttgtcgagtgatctaaactgctgctgcgctcacacttcgctataatatgtgcttaaaaaaatgagatgaacagatatcatacagatcaacagggatttataaatccccctgccaaccccccaaaaaaagcaagcaaaaaatctggtctgctgattgaaagaagcgataccccccacttaacagctctatcggcactcgtgaaggtagaagtttgtctgtaagaagctgttagacttgacaggcaaacctagctgcgccttcggcatacacgttagtgatattgtgccatcagcttactggagcaactcagtgggaacaggattgggttgtatgatttcacaaatgtaaatagaacatcctcttcctcgtttccttgctgctaatgtctctcttggtattatgtggataaagagaaaattataactattaattctcgggagttcccaaaggtaagactcgaaagccaccaaagagtactatatttatctttaaattcaacaatgaggtgaaatgctcttttcagaggtcaccgtgtagaatctggagcccacttagccagacccacgtcagctttattaaggggctgcctacatgcccagctttatactactgcgtgttgttgtttacttatttattctgctggatactgtagttgtgttctgccactgagctacacccccaggtccatgttcatttttaataagataatactataaacatatagtgaataaatgccagtacagcacacgatagataaattaataaaactgaagttccataccatcagcagaacaggaattataaaagatgacttcagtgtaagaggcaaagtcatttgttgagccccaactctacgtgaagaagaactcatattcaaccatggggggaaaaatgaaaagacatgaaatgcctgatctctccaaacttctgcactactgagtagatagcaagccaaactcaccaatcgatatatcctgtgacactggggattagtctgtggaggggaggggcgctacgtaagcaagtgaagggctcaagagacaagtcagagtcagtacgagtgttcatgggaacagagaccaggcactttgctgtatggattcttttgacccgaaggcaacggagaaatagcagacacttgaggcttttacccactcctctctgcctacatgtggatcaatttccatctttgatggtgtgagctgtatcaggaaggagtttatcactgatcccgtggacatggcactgaccttagtctacagaagcaaacccctggtttcttccatcttttttttctttgccaccagtagctgctcttagcagctccaggtctcttagactgtgaatcattagccttccctttgcatgtcaacatttaggatagtgaggaatactggactatcttatagccatttcagagtctctggggggaataggaaaaggaaagaatttgcattaaaagtcagctgatctgtcatgtcagaggtgtgatttgttagttttgggaagaccattattctttatggtacatgtgaaaatactgactgtgtaaagaagccccttatccgtggtgagaacaatggtaattaatagcagatagaccttctagaagtcagttgtgcccagaagtgtgtttcatgtaatcccccgctgaatgggaatttaagattggaccacatgaacaatctgtccttggtgcctcctgagccacctctgctctgcctacgtgaatgatgggtggaactgagctagtgggtcctgtcgggccagacatcctctccttgaggaagacagccttggggtgggatggactgataagaaggcagactgggagtttgttaagccatcagccagttctcaactgctctggaccctccctgcagcaggagggatgctgaggagtaagacctcctcccacctccactcacactcgctccttggtgtcttctctgcctctctctgctcgcatcacctttttcctagtcgtctaagtcagcggttctcaacctgtgggttgtgaccccattgaaggttgggcaagagatttttttttttttttttttgcaggggttgcctaagaacatcggggaagtacagacacttacgttatgattcataacatttgcaaaatcatagttaggaagcggcaaggaaaataacttgacggttggggctcaccacagcatgaggagctggttggagtctccttctctttatcacagctccaaataagggaaccctcagaagatctgggggtcactcagaacatgggtctgcagatcatgcaagatccagattatgaatttgggtcctgacttggcacagcccagtagaaacgcggctgtagaggaattattaactttcttaagcttccatttccatatctacagagtatttgttaatagtgctgttaggagccatgctgaattaataagaactacaaagataacatgtggaaggtactgaattaacatggctcttcttgtcatttcttggccccttcgtaacagctcttttctgacctttctatacagtcctgactgtacaggccagtgctgcgtcccctttttacaaatgcaggggctgagaagagcccatttgcccaaggttcttgtcttctgtttcagctgctgtcaaacagccggaaggcttccgttctaggcgaattccctccctgactgtacctgagaccaggttgttaagattttccgcagggcctttctttccttgcttatccatccttgcagttcttgaccttcttgaaccctacaaaaccagcttaggaaggaatctaaagcatgctggtcacaacgaggaccatttccctgtccttccctctgattctccacagttgaccaggcgccggtgacagccttggctgcttgaaccagctagagagagccacggaattccaggctgcttgctttcaaagggctccactaacccctctgaaaacaaagggttgtttatcacatatcaaagcataccgggcagggataattgagagatcttctgataggtcatgtggtttgtagtctctgcccaggcttctggagtgggtgggccgtgctcctgcctcaggtagcagtgacttctgtctgccaggattagttctgtgtaactgtcctgtaggtgtgcatagcatccgctcaccatcaacactttatatttctctgcccaggtccctagaaaatagattcacaaagaaaaccgtcttgtactttgtatggtttcaggtgactctgatatttcatgaattcacaaaacccgagttgaacacagcaccacctagtctctggtctaggagaggtgttttgttttttcttttcttttcttttcttttcttttcttttcttttcttttcttttcttttcttttcttttcttttcttttcttttcttttcctttcctttcctttcctttcctttcctttcctttcctttccttttcttttcttttctttttttttttagaatggaagtatcaacctgggttgggttaaatgttttcgagacaagccccaggctgcaggagggttttgctgtttagactctagaggaacaagccttctcttctcgccattgctttgccctgaccctgcatgtgtcaggccctatcatatgttcggctgtgtgatcctgtgacacccacatcctgttgctggatccaagcgctttgaggctgtattaacgcagattaattgaacagttgccctgtgaaaacagatgcccttcgccgctcgtttctaataaattgtcaagccatttaaaagacttccccttgaagaagtcatatctccccgagaagctgaagcaaaagtggaatgtttatgtcccaaattagtgtgctatatttaaaaccagtggcctcggcctgaccaggacataatccttcgccgcttaatgaaactgccatcctgtccctctgtattatatagtgaagttggttctactttctgtattccaaaccagaaagccgttgtaaagaactagccagaataagacattagtcttcagctatttgatgttttctttataaattaaaattataactgactttgaaataggaagctaagcctggcctcccctgaaccaaaaactgaaattttagtaacattttgcttacgggatattgtaataaaatgctctttgcttaagataaaggtatttgtccagtgacattctgagttacagaaaattgagaatgtattatagataatgtactatgaaaccagaagaacattctctctagttgacaaagatatgcacaatacaaagatccaggtattgatctgatgctgttcagagatcgagaaaggccgagagcaaatcctatttcaaagtgcaattcaagtaaaattagattcagtgagactatatcatttacccacccttgtagtaaataataaggtagaggtgcgagtctaagctgttacctaaaggaagtgaaatgacccagagagatgagcatcccatgacctcccaaatggaatcgaagcagttgaacttgcaagagtagacactagatgccagtggatggggtaaatgggagatgttgttcaaagggtaggaattcgcagttagacatgggtacatcatagagagctggagtatagatattgtcactgtagttaataataagtgttatattcttgaaataggttttaagtgttcacacacatatagaacagtatgtgtagtgataggtaacttcattagttaattgttatttaattacttaaaattatatatatgtgtatatatatatgtatgtatatatatgtgtatatatatatatatatatatatatatatatatatatatatatcaaaacattatctcgtgcatgttggataagataacttttatttgctacttctttttcacaaacccaccttgcacttcatttgtaaagagaagtgaagtccctaacctggagggttacagtaagaatatcgtgtaggcttcagtaagcatttgtcattactgatgctgctgtaagccagtgctcatgactggctcctctccccttcctctgccagatgttctcagtggctctctgatgatgcatgcagctgtgtttctgagggacaccatggaatgtccttaaccctctgtcttcaggatcagtgtttatcccacagtaaaagaaacaaatcaccatcaaggttgctttgtagcaacatacaaacccccaaagctcacataatgactatgtgacaccatatgaatggacaccatagccaccatgtaacggctgatgacagatactttctccccgttttagtaacactctgctgcttttctgtcccatcagagttccatgtctttgtattatgtgtttattagatcctaggcatgatgtatgcagtactggttgccatcaaaatagattgtagagtttaatgggaagtctgggagttgacatccgtaccctacataaaaccaaccaaccaaccttttaaccttgctgattagctatcattgagtaatagatttcccacctggaccaccacttatactctactaattctaatccagattctgtagctctgttgtctgtctaaatctgaattcttttctcttgactccatctgttttgtcagagcctagtgtagaagcggtggactttgagccttacatggacccaggccaacagttcttctccccacatccggagaccaggctttgccttttacaagaaggaaactgcctctctgttcccaagacaaagctccctcgactatagttgctgcatgtttggctcagaggtttgcacagtctatgtgtataggcaggccatggccttgctgggcctgctggaagatggctagctctcgctggctaatagttgactcactcaccgtgggatggaagctctggcctggaccagactctggtcagtgtctgttgatctcagggaacattccacagctgctgatgtaactcaaatgactggagccaactcttctggaccggttagagggcttgcctggaccagttagatgactggctgtcactcagtttatctgggggaattctgtgaagtgagtgttactttcagttcctccatggtaaggggaacttctctcctcttatcttctttttgcaaagtgtgttttttataaaaccaaagtagcatctttgggactgtggtggtgccccgattcccgattgggaagccttgggaagaggctgcagaaggatccagagttcaaaacagactcagctacagatgttccaggccagaccaggtgacatgaaacggtgtctcaagaaccctcaaaataaaatcatcaaaaatagagatggagtttataaatgatgtggctactatttcatttggtaccctattcaacatgatcctcacagtgcttataactccttttgcttgaacttttttttttctcctgagctggggctcagaccagagccttgtgtactaagtaaaaagtactgtaccagtgagagctatcccaagactgaaatatctttttattgagagattcctcatgaaatgcatactgaggcttttgtttgtttgcttgtttttctaaatgtgattgcagaaccagataatttgtgagactgcccatggtatgaaaagattagttttcctagtctgggtgtgggccaagacctattgttgtttctgatgcaaacccaagaccaaggactgcggttgcaaacttacttatatgactgccatgttcctaaaaaagatttttagaaacttaaattaaaaaagcttcaagcagcccaggcacagtgggcacacctgtcaccccagtacctggaaagtcaaaatcaggagttccaggtcatcctctgctaggtacaaaattccagagaaccctgggctagctacctgagactgttttaaaacctgcaacaaacaaacacaaacaaacaaacaaacaaaaaactctcacataaaaaattagaccaatagaattaggaaaacaggccactagataccaacatacattttgttactaattttaaaactatcccttagatgcacagaagtacttatcagataactgcagcttaggggtcgcccgagtttactaggaagccatctgtttatgggacaaacatgtatctgctgtcatcaggaaggtcactggggtagctgtgactcagatccactaagggaagggacagaaataggactcctatcttttgtatctctgggatggtgaccagagaggtttatgttgttgctatgtaggccctttttaaaaactccaagctgtaaatactgaattttagaagcacatcgtcatggctttagaaaaacaacggtctaggatttccgaaggagcttgtggctcctgcagctattcctgatttggtgttaagtttctgttcttaccaggtatcctgacctccagtgtgggcttctttcagaacacttcaattaaaaatgtaattattagtgtggcattcgtgagaacatgccctggtagagctttagggatgagaagacaacgtttgaaaattgattgtctccttctgacatgttatcccaggttggaactcatgttcccatgcagctcaggttactaggggtgttgctaagtactttcacctgagttatcttccctgccaccaatcagaactcttagcagtcaaaataaaagggggaaaaagggtttcatttagtttttaaaagtcagtgtgttttttcaagaaaaatagagattagattaaaaaaacacattataaagtaaattttaaagccctctttgtttttattgaaacttgtatcaatttctttatttggcttaccttgggacaccaggaaagagccaaggtttcctagaacacagcttgaaatccagtgttccaaaggccccctagtctgtgctttcattttggagcaccatttttttaaaaaataaacccagatttgaagatgaagagataagctgactggccttgaagttagggccaaggcctaacaatagctttgaaaccagttttatgttttcagaaaccaccaaaccagccaggcatactgacacatgactttaatcctagcactcaggagacagaggcaggtggatctctttgagtttgaggccggcctggtctacaaaacaaggtccaatacagctagggctgttacaaagagaaatccccctccaaaaaaaaaaaaaaaaaatcaaaagaaaaagaaagagaaagagaaagagaaaaagaagcaagcaaaaggaaaggaagaaagcaagccaccaagccagccttaggtccagtgtcgttgatcagacagttcatctgcgtttgtcaccactttactttctgggaaggaaagcagggattatatatatatggtggatagagataaatgagcagctatttaaaatgccattttttttgtacttacttataagtcaaatctgtgtagatactaaagatgagttatagagaccagacttctgttttatacatcaaatttcaattttttcaacagtaaccttattgagaacctacgtgatttacttaaatgaaaaacagctttccctagatcctcatggctttaggatggagcctagtggttacacatttctcactgccttagttttctgttccgtgatcggtgatccctgggagaccttttgacctgtggcaaggcagcacagcatggtgggagcgcatggctcattcacctcatggctatgactgggtagaaagaagaagcaaagattggagtctccacgtcttcattaaggacacacgcccaaagacaggaagacctgcaagggaaagatcaccagcgtggaactctttctcaaaagttaatccagatttcgccatcaaagcctctgccttcatggtgaggcatatgcgacgtgcctctgacttggtagagctaaagacaggaaaggagaaaagcagaggggttgcggggggaggggcacttgtacttttcatgtcttccagccaagcgcttgcacttgccctcttatggaagactcgccatccggacaaaggagggtagttacggccaaagaatgaagttgctgagtaaaatggatacccttctctatttttttttccattttatcctggtacctggcaaagaaaatggaaaaatgaaaatttggttggaaaaaagtcaaagacgcgtgtaattggattagggctggggattgtagcaccgttcagatcacttggctagcggtgccctcagtttattcctcgacattggtgggggcgggggcagggggagcaggaagggcataaagggcatgtgaaggcagaaatggtgggggctgaggagatagcttaacagttaaggtcgctcttcgcatagtcaggaggagcagagtttggatcccagttcatttcacagcccgggcttacacccatagctgtaacttcaattctaagggtcagaggcaagaagaccagtgagcattcttctctccaccccacccccacccccagcacataaaaagtctcagagccaagaaaggacagtgcctcaaaggaataggcagaatggtggaggaggagggacctacagagcacatggatgcatgtactcacacagacagacagacaaacagacacgaataaagtatgcatgtactcacaccaacagtcatacaaataaagtatgcatctactcacatgcatacatacatacagacagacagacagacagacagacagacggatggacagagagacagaaaaaaataaagaagtcttttagcagaaagagaaattgttgttcttgatgctggaggcagggggaatcacaagtttaaggctagcctgggcttagattctgtctttaaaaggaagagggtgagatggcttagtgaatagaggttatcgcctctaatttacctctaagtcacaaaggtcataaggcattcatatttatgtctggttttcaacttgaacttcctagtagtttggtcagatttttaattcctgagtaagaagttggaagcctctacaggtaatcgtattagccagctccaccttcatgagaagctaggatctcgaggtaggctaatcttggctttatccctggcttactaagtgattatacacagagattagttctaataagggatatctcttcctgactacaccttggaagcatgagtgcaaaggtctttaaaactttggagctaagcattgcagtccggtcagggaggcctgatggaatgctaaggtaggctgattcctagcaataatcttagtgaacgaagggcagtccatttttactctgagtccactgagtgcgtcagacttgaagggtttatgaaatgtcgaattatcttgactctgagaaaaatggtcagttatagttttagaggaatctttataaaatcctgggttaaaaaaaatgtattctcagtttgcattctgatttattcacaatagatctgagtcacaggagataatcacccctgttgtgtggggacccaacggagacaagtgactgtgttcccctggaatcacagagaaacttagtatgaagagcatattgttttataaaagaaaataattatgcttcctgttataatgcctgaaaaatccatggaagaaagaatccaaggaaggctactgaggatcggtgacgatagtagtagttgtagtgatgaggtggaggaaaacattgccaacctcaccacgcaggctgggtggacaagctggaaggtgaagcgtgattgaatgctattggacacttgcccttaagtctgtcacacattgttgttctaagtccacagggtaagcacctatctccagcgagttgtcatgagaagacaggattttatacagtgtgtacccctgtagattcaagtttcaagtggaatttttttttccctgccagttttattagaacctggccagttgcctcttaactgctaaacactaatactttggaagttcctatgaaatatagaataaaacaaaaagcagaagcaaaggtataacaaaacaaaggatgggcagacacctgctcagtcctgtcttcactgcatttgaaagatccctgccgtgtgactccaagtcagtggattagagacagaaacttccgcttttcatgttcaaagtcaaggtcaacactaagttaaagttctgatgagggacaggaagggaaatttattatgagttatctatttaatacatagtcaaccagatcctactgggtggtgaaagctttctcttactagttatggttggtttttctcttattttaatgcttaattagttgctttagtccaaaatatgtgtaacaagatggagtctctaatctgttactgattagatgagtctactgatacatcccctgactaatcatacataacaagcaattagcacactgaaaagcaatctggatctagcattacacaaacaattacgtcagttgctgacttgaaaatcccagctagagtggtaataataactgaatgtgtgaataggttctctctttctaggctgccagtaagttacaaccttttcttgagttgggtttcagcaatgaaatatagtgaacgtctagtgtagattagattgaagtaggaggaccagttacctatctattttactgttcttgacgtcaggcaatccttagggtcactgcacaaatatttaaaattaggtagagacactaaagggagggatcatttctgagtcaccacagcttatttctcttagaagtggtttgaagattcaatgcaaagaactttgcgctgtggcctaatttagtgctgctttcccccttcaaacagaataggaataacccagtgtttatgtgctctttgggtaagcactaagccagaggattccgtacttatagaaatgagtaaatatggagatgctgaacaagtcaggcagaaagcacaattgcatagcaggcctgtgggaaatgaacaatgggggaccgagtctataaatgtaaggaagaactgataataacttttgaaaagaatattttatacatccagataatctaattcattatattaggacaatgttctttttgtaggtttttttgttttgtctttttttttttttgtcatgaatgaacgacttgctgcaatgtctaactaaggtatatatttcagcctgaactttattcagaacgtgagcatgtggcattgctaataacttctctgttccctttaaatggaagcttctttgatgttccttaaatatcatatgtcaagcatagttttttttttatgatgatataatgtcttatcttgatgagattcctttctaaatgtccctgcttgcaagaagaagccttcctttagtggctcgtcgcatcagatttttgataacccagacctggatgtcgtttcatctcaaggtcataattatagatcgtgtttatgttgcttctgctccccttaggagagctgttggatctttaagatgacttgaatttggtgacaatattaagtccatggccattgaattgcttttcgattcagaggggcttgctttgattagggctttttctctagtttatcattccttttggcttgtataaaatattgtcccttcatacttacagttgtacataccataataggtactttcttttttccataatgatttaggtacagacaaaactaataatgctagtttgtcaattttctcttagaaaaaaggagtcgacgtatttaaatgccttgctgaacacactgctttctgccctggtgtctttaagaagttgataagaatccccatgaactggaatactgttatatttttgctagtaagccgtggcattggtaaatagtgcagtattctatttcatggaccctttcactgttttattgatgacgtaaatttttattgccccaagataggtgtactcaaaggggaaaccagagtttctttttggtagtaaattcccatctaagggatggttttagctgcttaagcagggtcccccttacccccaccccaggcttcagatttgttgtttcctatgatggtgaggaaggaagggagggggactgctactaaaaataagaattgctcaatcaaggtgaagtctctgtttgggtgttttaagttcacatacttgtgctgtccagactcgaatgaatatggagacaggaattagccttcagcgtagtcttggccaagcagctgagtcatttctgtatacatatcttaatagtttggaatattttagtgaagtcagaatacctagaacagatcttcggagttcccagttgtataaaactcagggaggaccttgactttgattctcagaactttccaagtgttaaagaagacattatgctggacgtagtggtcatgtctgtaatgccagcactggggagtctgaggcagaaggattgggggttcggttctagcctgggctatttactgaacgtctatcttcaagtgaaagaagggttattagttttcgtgtgttgttatagtcagctccaagacacacttgtgttgggcaagcttttctaaaggagtggggagtgcctccctctccttttttctcccctcccttgatcttccttgtgtctcctccctctctggcccccttttcattcttccattctctcctcctcggctccattcccatcactcccctctctcttttctttcaaaggctcttgctatgtagcccatgctagccctttcctcatccccctgctttccttaacctccacagtacagtgctgtgattccaggaacatgcccagcactgtgccagcctcttgctttttttttttcctacaggaaaaattcctttctgaattttcctcttcatttccttctttcccttcagtcaccccattccacactccactggggatcaaacctagggccttctacttaagttctgttaccaagcaacggagggagcagcatccccttgaccttgtcatctcacccgttctgtattttctttattagttaatttatttgctttacatcctaattgtggctaccttcctctcctctcctcccctcccctccccccttccctcccatccccatgattctcctgtcctccctttctcctcaaaagaggggaggcctcctatggatatcaacccaccttggcatgtcaagttgcagtaagactagatggatcttctcctattgaggttagacagggcagcccagttaggggaaagggatccgaaggcagagagtagagtcagagacagcccctgttcctgctgttaagagtcccacatgaagaccaagctgtacatctgttacatacatggagcagggctaggtcagtccaatgcatgctctctgtttggtcagtctttgtaggcccttatggacctaggctagttgattctataagttttcttgtggtgtcctttatctctctggttccttctatccttcttctttgttttgttttgttttgttttgttttgttttgttttgttttgttttgttttgttggttctagggctatggcccaggactgcacacacataagtgtaccaccattgagagtggctctcatttctcatcagagaagtttttctctgcagacaattatagaaaatcacacttggctaaaaggcagaaaacaagtgatcatggagggctcagctctaatggacccatctacaacataatacatatcttgcccccaaggctcaaggaacctcttggaacagtggctagaaagacagtaagagccagaggaccaaaagcgtgaggtgagattgtgtctcctagaactaacagagaagctacacccaggaaatgtcaacagtatggtcacctgaacagggatacggccactagacatgataaggtggaaggcagaaatttcacagaggtcccatctttagacaaataactgtagacaactaagggatgctaagaatgtgagatggagtcttcactagccatgagcctcttaattagtcatttcttgtcttttgcaagtcagtgccaggtaaatggaaagaaactctgtggtcctcaaataatgtgtctgtctttcacatgactttttacaacatttggctcgatatcctttgtgaccatatgaaatgccaccatccccaatcttttccatgcattaaacagcagtgtgtatcctgtgttttaaacaagacagagaggcgctctgcctgctcctaggggtggagatttcctgcatttcactctgtccttctttctaaggggaagtttagccggttggccttggtatggtattcaccatgtcatgtggtacccattagcatagcggtatttaccaaatagtaagattctggccattacgtcatctttttacttagctgctgcaggacatgcgtaacacgcaacgctactttgtaaagctctctgaagccttctctttataaaaggagcctggcattcaggagtcaggctgacctcccttacacagtgtgagacaggaggtgatttgtgttctctactgtgaaatcagaaggaccgagtgctctgtgtttgggatgcaaagcaccagctcatccctccccgcaggagtgcacttcagcagattctggcatccaagctcctgccctttctcttcttgttctcattcactaatcttctttccttgatgccattttgttaaattttgcaagtgtcattttggaacctagagatggggtttgaatatatgcatctatcatcagtcattttacatttattttgtaaaatgaaaacttttttttttgagaggggaggcagtgtctttctatacagaccaacccagcctcaaattcaacgttctttctgaccctcagccttctgagtgctgacatctgtgtgccatccggtctcgctggaactttaaacaaactatctttgttcattttacctgtattgtctaaaaggcaaaacagacccagccaaattaaataaataaataaataaataaataaataaataaataaataaccaacaccttgactttcaccctgtattaggcccttataagatcgagggcttttgtgttttggggttgttttttttttgtttttgttttgttttgtttttttgtccttgtaagttcctgaattttatttacatacacatttgaaattcttgcgattgacctctgaaataccacaggcctttgcaacctcagattttctcagcctgcttacttcctgtctcctctcctcatttggcatggtggctctgcaggagttttataatagcactcaccacttctgttccctggaaggattcttttggttttacatactttacttaaatactagttaagttacgattggtcacccgtttcaaacgtcctagcacgccgtagcccgatgtttgctttaagtatggctattatttcaacttcttaaaaacttgttgctctgtatggtagcaagatatatgtgtacataaaagataccttctaaaactctttaaacttgtctctttataaaaggaacatgtaacggaggggtctgggtgggctctgccctactgtgtaaatggacctcctaggcaaatgcatttgagaaagcttggttaaagtgacccaacgcttctacgctccagatacctaatgaaggagcttctccccgtgtttgtaaacagaatgcacccccctccttgaaatggcattttctagaagccattttttgagaacattcatttaggaattaggtaaggtctatagtcatagttttaaatttttccaataccacttggctgttctgagtatagataatcacctaatgatagatttagcaatttagtattaataagtttatactaaaaaaatgtgtccataagagaagttctttataagaaacaacttttctttattctattattttcagaatcttggtatgttagccttgaatccatgccctcctgccttagtttcaaaactacagacaccagtggctaccatgcccagacctaggacaaaaattgacagctgtagctacctagatgaaccaagacagccttaacagtttgaactgtgctccttcatctcatttagaattagtgattcactgcgaataagctgtcaagaatgggagttcatcaaccacgtattagccaccagagctcactttgccgttcaactgtgaattaagggctcggagatggtttaaaataccacacggccttggtgagtcagctctgccacacacactgcacttgtcgcttcgtagccgggagtgacgacatatgagctgcagtgtccttactcgtttgtctcctggagacaacttggcaggcagacatcttgcagataaatgaggaaagattgtctatttcaagtggcataagacattccttaaagcagtgtgtcatatctgcttatacagtcagcattttctgtggagcagaaaatctcctctccggctccctgggtacacagcaaacatctttgtgtgggtagcgtccaggaggcttcagtggctctgttgtctgtagatgggtcaggaaatttcttgtgcctgcatacacttcttttttttcttcttcctgttgaatgcaagcttggtcaatctgggtagcttttttaaatgctcactatacaactcctgtgtattactgaattgtaatttaaggtcaggtattgagaactattttagagagaggaactaaggatgaaaatcaaaaggcttggttggactggatgattggctcagaggttaagagcactgactgctcttccagaggtccagagttcaattcctagcaaccacatggtggctcacaaccatctgtaatgggatccgatgccctcttctggtgtgactgaagacagttacagtgtactcatacacataaaataaataaataattcttttttttttttttttgatccttaagacttttaatatgtcatcatttagtctgtcatttctcaacatgctttaaaactacaaattacatatttttaagatttatctatgtacctatgtacctatttatctatgtatctatctatatatctatgtatctatgcatctatgtatttatgtatctatgtatctatctacatctatctatctatctatctatctgtatgtatgtatatacatgcatgcatacatatgtacatacatacatacattaaatagagaaggaaaatttaatcaatttttatgattatattttcaacttaaatatatataaataattcttttaagaaagaaagaaagaaagaaagaaagagagagagagaaagagagagaatcaaaaggctctctcttcaaagttataaatgctaaattctaaataggaccttttctcatgatacaaacatacccatctcttctgtgatttgttttgttttccagtccctagagcaactctgaaccaatactctgaattttctagatataggcagtgatggattagacttgactaaagatgcaagacatggggaagtttctggaaacattttttaattcataagtgttcataagggttttgcattgggtaatcaaatgatacaaatggtatgtgtgcatatggttgttatcccagaacagtcaagacattattcaaatagtttccagtgacgtcgcttctctgagttggtctaaggcacttaaagaaacaatgactatttggaagtctttagtgacaaagaagactccagctggctgtgttgatcttggaaccaggaaggacactagaatgagatcccgtggatgtgctcagaagcagagaccagcccatcgcctacagttatgtagggtggttaagatcgcctgcacctgttcttgactgataaattataagttgatcttcacagaatgaacacaataaaggggtgtgtccgttactgtatataacgtaattatggcctatcctgtgtgatcacacactgaagagattacctggctttttaacctgtgaatttggatcattggagtcagagtggggcttcatcctaatatatttgtaatgttttatccccctttgtattgtattgtaggattcacggttataacgtcacattttgtcttttgattaattaattattttggtatgtatgagaagcagagactcgtgggctcaacctctgtttgagtacatgttggtatttggttttcttgttggaaattgaccaggatttatttcatgcatgctttacacgagccttaccactctacctaagactcaaggccaattttgatgtattctcttagaaacacagaggtaaataataaatgagttttctcctaaagatttaaaagcttagttcagaatttcaacgaacacactgttgagattttccagccaagtacttcttaattctctatttggaagggtttcctgggagaaggtggcctgtgggggatccctgacgtcttcatggtaggtacaagcagggccacccatattgtgatgaccaactatcccaatgaccttggatttgcacatggaaacaattctggaagcaaaatgacttcagaaccatgtgagttagccagtggagagccactgcatggttgaactacacatgtggaagcagtggtaagccttcactgaaaactacactgtgggtgtaaaaccgagtgtttgtgagaactgaaaagccatcttcctgagggtctgagaaggatgctcttgctaattactgcctccatttttttttacttagaatgatatagaatcatgtagagaatagccccaggaaagaaggagccatcgtaatacatggtgccatcattttaaaaatcacagctatgtgcattttgattggtttattcaaacaaaagtggctgtatcagtatcagtgtggtgtgtgtgtgtgtgtgtgtgtgtgtgtgtgtgtgtgtgtgtgtgtgtaacactctctggatagattgtgtagtaggacttaaatcttcctatcacctcttatactccagagaacgatgtagcttgagccccatatcacatctccatctccatttcaggacttagcctctatagatctgtcagaacatccctggagaacagggcgtacatggtgacagtggagttccttctcctcctcccccccaccccccgcctgtcataggatatggctggcatacccctccccctgaactctccagtccaaaggctgggctacccttctcctctggctcttttctgtatgatccaatggtccttttgtggcctcctgtccttttgttgtcctgatcttccctctccctttatggctctcctcacactgccggcctcatctttactctgggctgtcccagatgtttccatctctggctatgctctccctcatatttacagtaaacttttcctctactatacctaggagcagttgtgtctgccagtttcctttcttacgttccttctcctgcaatacaattcacttttgtaggggctgagaaggggccggctcatcctcttacaccaatgagcgtccttctcttctggtttttggctagggcagtagttccatgtgtcttcatttagtatatactcaaggctgcctagctgctcgtcctgagatgtcgtgactccttcccacactctcctgtgcttcttagctgctgcggtcatcaccgtgcctaatccatacaagtgcccccgtcctgtggtgtgtccaatgagacaccaccatcctacctttctttattctttcagcactttctgttctgaggtgagccttgtctgagcctgtacgactgggttggatctccccacagtccttttctgtggctatgcttagtgccttggaaatgtttacatgatcctaagtcaccaaaccagaacttccctgaaacttcgcctccgaccgaccgagacaattctgtcctgtctactggaagtggcaagggctccgtagccatcagcaccgagtttgagtttggcttatctgtcagcggttggtttcccgcatcatcctgaaagtattttctgttcactagttcactagcctttctttcacttcaagtgttaggttaggagtggaaatctcttgagaatccctttgtgcagctgaaggcatctcagctgcaagaactaaaacaaaacaaagtagctgattgggtgcttcattcaggaagtatggctggccactgtgtttgtgcaatcctggagcccagtgggacaagcctgttactcctctcaggaatgtgctattcgagcaccaggaagtgaaccgagctgcctggctcagaaatcccccttgcgttttgagctgttgcctttagaatgttctaggaagagcccgaggtcaggccaagttcagctgcaattggtaatggcctaagagtgaattctgtgctttcttttctccattggctcccactgcgaaaatcttatatatccctaagtcggggtttattttatatcgttgcacagctttgttaatatcgacaagttctttgcattttgattttaatgttattatttttttacgccgggcattctttagctcttgtatttattgtgggagggaggcaggcatgttgtagagagcaaggaagttgtcacaggaggtggagtcccgtttatcttgtttgtactttacaaactaaacacaagccttcgctctgcacttacaatgcttagctggatgctagctggcagtaaagacttcactgctcttatcacttttgacttcaaattgccccctaacacaaaatagagtgttgttatatccctttcaaaattatagccccccacccccacccacccccccagcattgtgtttctgagagcctttgttgccaaaggaatggcaatttgaaaaagtggtttttgttttgctttttggttttggtatggctgggggccatgaaaagggaggcatctttgatagtgcctgactctaagttacttgagaaggatagtctccctgttcttatcaagcacatagctggaaacagaaacctttgagtattctttacaaccctggagaagaaataatcttggcttaccctaagagagataaggtaacagaaagcgactggaacaatggacaggaatgctgtttttaagtgatcaccaattttcacatggactcccgtattcgctctgagtctttcttgtgcccacaaggcagtttctgctacacccagtgcccctgtggtaaaaatacaataccatgagagttataaacgcaggggaacagccgatgagccaatgttatgaagctttggaaagaattaaaccaagggataaaatgtaaatatttgttctgctcatgtaaaaaaaaaaaatgtttcacgtcctcatcctgaagcattccctgtgactctggtacacatagaaaggtgacgtcctaaggccacagattgttgcttaagtgaaaacccagattcacttcagtcctgtctgagttggtcactggtctcttggtatctttacatgaatgtgtacatgcgcttctcagaataatgtgtggcaagaaccctcactgggtatgccacacccatttgagcatatattgctttcaccttgggaaccgtggccatagtgacgtgtttgctgatgaaatctgtacacaactgaccacaagtagtacaggatttcctattcatatagctctaggtaaagtgtgagtagagatatagtctacttgataaacattgtatccacatttgaaatatttccttgtaagtatgtattggccaaaataaaatatatacagctgaaaaaccatcaggtggctaaatcgtgtctttgcagaagtctcaaagagaaagaatcagaggagggctatgtaattagtcagagctagaacttggtagcagttgattgacatctccctataggcttcagtgctgatgcttagaacaagactgcttctacttaggtttttcatccccagatctgtgtgtaagaaccagcatcatatggtccatacactatcgctggtcctaagtcctgtcatgcatcacatactggacgtttacggcacttctggcttagaaggctgctattcaatgcggctagtagttgagattttcacttgccaagggaaggtatttactgtgtatagtgaggcccaaggtctgatagaaaagatgggaagcaaacctgaaggtaaatttgcccaacacaagtcttcattgttgtttattttcaagcaaaagtctatttataagcgaggtctgttgtaatattttgacttttagttgtgacactcattctccccccccccccccaaggcttacttttaatgatggttcttaaatgctttaacctcccttttagccctctacccaccagatatagtggaaagggatacgggggaagtacatctgtttagaaatggttctttggaacaagtcccttttgtgttgtctagcaatcagcagttcagtttacaggttaacagggcagcttgactcactcacaaacacttcacggatacaccagcagtacagtttggcaaagtcggtatagcaagcacgaatcagcagtggtggcactacctatcagagacagccaggcctccacctccacttgagtcagcaggagggaccaaggccaacaggaacaccagcaaaagttctcagcctctctcagcaaaacaaagatcagtgaagacaaaagaccaacaagcatttcacagctagctctataaggaagcctagctcagcctccgtcactgtcccttgagtcctatttataggctaggtgcggcagaaattgaggttccccagcagcaagtgtcttaaacaggggtggggttcatataggttttatcttagaaggcttgactttgggggaaaatgctaacctcatatacgtcctatgcaatcagtctcttttgaagtggcttgttttttcataattactactcttattttcattatagtctcctaaaaaaaatggcttgcctccagagtttcaattgtttttgacaaattaccttcaagaatcaacttcaaaggagggtaaggtttatgttgggtcttggatctggtgctatagacgtgttgacacaatacatcatggcgacccagacacaaaggggtagaaccaagtcttaactagttgctattgtatctcttttccctttcagaggcatattgaatgacttgacttttagtacctgttaagggtttccctacttactggcagtgccacaggctggcagccaagcctttgacatggacatttaggggacactccagacccaaactatgaccgttacattctctaactgtagtgtttctctgaaggtgaatgcatcactgtagattcaacttgataaagtaagacagtgtagctgtcttcagacacacaccagaagagtgcatcagatcccatatccagatggttgtgagccaccatgtggttgctgggaattgaactcaggacctctggtagagggggtcagtcagtgctcttaagtgctgagccatctgtccttcttgaggctgtcctaaacaacaaccacaaactcaaatcctgaaaacagctcagcgagggccagagaacccatcaagaatgcactaggaattatagaacaaagagagttagaaatccaaggtatttaaaaaatataccagtagaaaagttaggagagcagttaaagccagccgaagactctcaactacaacctcccagtccaacctgatagatagcattcaaagtctttccataggtggaggataggtttttattaggttaatacattccaaaagatttgatttgctactccagttcctaggtcaacaaagatgggcaaggtttggctccttagctgggcttgagatagcctgaaaataataattaattgtcgtgttgaatcagcagcgttgcaaactgaatggagtcactgaagtttttatcagtgttatcagcctgtgtacagaggtgctttccaggaatgttcctgtgcatcgagcagttcaaattctagtctttttttttaaagggtagtggggacctaaataggcatttgttggattgcaaactaactttgaacctaatccttgggttatctcacaaatacttctgtttttgttttttttttttaaattccaatttctaatccatttatagttggttaagcagcagtctgcctgccagtctttgctaggccttcctataatgcaagctttcagcggcagttattaatctcgtgggtgttgaatgataaacgctgctgctttcaatagacctcttggtttcctgctgggcatcagcagggagcatgcttcagtagccttgagatggggcagagttttggggtcagctggagaacacctgtgtggccctcatttgcagagcatggcatccacagaggccaggaaaagcttctaagagcgctgagttgtaatttgaagctatgtcagcaagtgactccaaagaatgacgagtttccaggtgtgaaaactacctacattaagtctgtgagagcggttatttcccctcccctcccccttctctactcacttttgtaacagatccttctaggctggaactcaggctggacatggctatactgtaaaggtactgtgacttgctgtgaccaccatgtgggtaatttgaggagcagggttctaacagccgtcgtggttcacttttctgtacgtgtttggtgggcaattctgtcctttgtccccacacacatatgcatctgcctttgacaaacagtggccaacttctctctgcctctgacactctagccatggatgaaatcttagtctagtcctgcttcaagttggcctaaatgatctttgcactttctttcctttccgcgattgtaatttaagccctagtttcctgttattgacgaaacgatgctctgcgtatgttctctgtggatgatgggttagagggaccctccctcgcagagtcttgtcttttggttggagtagcaaaatttgctcatagtgattattcatccttaaaaggagctcacaggcaaacttcctagattgtcattacggaaatcagttcatgacctttgaaaggggagaaggcgttcagggttgaatttaaaagaaacttggagtgtacagtgtgtgtgtgtgtgtgtgtgtgtgtgtgtgtgtgtgtgtgtgtgtaagtaatgtaattgaactgtgctcaggttatgagcaagcaaatagtatttatgcaaggaaaaccaaggataggatagaaatagaatccgtcttttttttaagagcttatacaagaatcccaccaaagaagaaaaaaataccaaatactacaccatacgagagagaattattcaggccagtgagaagcctgcttggatgtagaaaccagatggtcttcattagccagaaaccttaaaacgacataaatccactgatggggccaagcgatggatccatgccccgtcttgccaagctggcctttttaaccaggaaaacagagagctccttgttcaagcccctcttagctgggactggggtgaagaatgctgccaaacccgttctataaggaattctgatcttgataatgaaaaggagagaaagttcctggagagaaggagcgccctgtttgaaaggcagaaagagagcttgttccagacgctgcctcttcccttcattgtaaatggtaggggttggaggggtagacttccccattcaccctctgcagatgggtccaagtcaagtccatatgtttacctttattttagctctgctgatttaaggccaacatctagctgcagtaccatgaggaaagtccatggcatgtctttgctctctgtgttgtggctcaaggaaaaaaaaaaacaaacttttttgttttccctgatagcaaaggtttgtttccaaaaaggttagccgtgtttttaagagtaatatttccgtggctctagctcagcgtttttttaagtagcctctttgcttttgaagccatggctgaacacctactgtttcagctggctgttttgtttgttggcaccgaacactgttttcccatgggaaaaatatctccagtttcaggatggcggcagcaatccatacaggttattttcatacgcagcctccacaaaaccacacgaaccacgcagagccacctgtgtacagtatgggttctagcccgcactgttgacttacatttctgaaaaaaataacctggtggtgctaatcccactggtggagattaagaccactgaaagaattttttgatccaaatttgaagcaagcttttaattaaatactggccaggatgatgaactctggcggggtccattcttggggtcccaggaaacagtaaagagtaaccttctgcagaggtttgaaaaggccaccccaacaggccaccatgtttcccatcagggccatccagagcaagtgtaggtccagacgtacttcctgcttgtgtacctcctacctacatccatccaatctgggccaaaggtcctacatcctgagataattcctgtctgcatgcatctggtgcagttgagtcaagcaaacttgtttaagggagttgcttccagcctctctgcaaggatctgtccttgggcaagggacttacaggttagaggcattgttgtttaatggatctcttaggcacagtaattagaacatacctttggctctcacggcggttcagtggagtggttattccactgatcataattctccacttactaagcggcatctgttgcttttccaagtagggagatattttttagaagcgtggagtagatcttccagttgacattgagaggagaagaggaatctgacagcaaatatgttctaggatagaaagacttcaattttatgaacgttcatactgtcaggctctgagtagaacattgcatgggatttattaagctttttcttagagactttgttcaggaaaagaggtttgagtaaacctgttcggactggccgtgaggcaggaaaatcttacgttctgtgtggccccattgtctgatgctgctgctctcttcttggatggattctgaggctgggttgcttatagcaaccagcatgttgacagatgcaggtgaggatgctgagagttgtcttgtgctggttaacttaggtgggctacaggaaggattgaaaggcttctgattcactttgtgtgtttgatctaattgcttcttcaatatccagctgcagctgatttggaaaagaattttccattagagacatggttttttgttttttgcttttgtttttccttttaagtacacatttgtaaaaggtagcaaaatgttacataaaaccaattctgctgttcctagttcagtaatctattataattttggagggactagagctgaagttcccaaactggctctactttatggaaatataatatgttgtttaaaaccttctctatctatgtattggctttcatacttaatatttgtatcagctgcttctcttgttgctgagacagaacatctggcaaaagcaatttaagtaaggcaagctggctctctctctgagggtagcatccatcatggtggggatgtcatggaagcaggaggatgaagagctggttgtgtcagatacatagtcaggaagaggagagagatgaatcctagcgaccaatttgttctctcctttttttactatgcctgtggtcccagcccatacgatgaacctgttggtattcagggagggtctttactcttcagttaaacctgggtggaacaacccacacagattgttcacaagttgaccacagacacaccccaggttcgtttccacggagattctaaatgcagccaagttgatgatgacgataaccactacaacattaactccccttgcacagaaaacccgaagggaacataggcatatattttctagtttaaactcactttgctgagctcacaacatcatcagaagactacagggccgtagtcagtttctttgaagagatatggaaaagatcaccaccttttgtcagcacatgtattctacaaacagatggcattaaaataattttaaaggtaagagggagggtggcatagagaagtatgaaagacagaaaaacgaagttcaggaatcacacttaggaaaataaagcataatttatttgataggtttaattaaaaaaaaaaaaggtcaggtagtatgacagttgtggaaaggacttgactggttttagctgctccacctgtacaatactaggcttgtcaccagtgtcatggatgtgaggagcctcctgtgctgacctactgttaaccattggattgcgtgaggtgcgaaagagaagatcatttattgtcatcggttgtgcatcagactatgggaccaatgggcttctacagctagttccaagcctgtagctatgcagatggcccgggatagcttaaaatcaatgaggaataaagcaaagcaaactgtcatgaatgtggggaaggggcttgtagagaggaggggaaaggacaggagtgggaggagcattacagagggtctctattgctgtgaaaagacactatcaccatagcaactcttagaaaggaagacattaaacaggagctggcttccaggttcagaggtttagtccactatcatcatggtcagaagtatggtggtacacaggcagacccggtgctggtaaaggacccaagagttctacatctggttcgtctgacagcaggaagagagagtgtgtcactgggcctggcttgagtatctgaaacctcaaagcctactcccagtgacacatttcctccaacaaggccgcatcttctaacagagacactcctggtgaccaagtgttcaagtgtatgcacctatggggaccattcttattcaagctgccacaggagatgaaagtaagcagtagacacttcatacacgtgtgaatgtgtcaaagaacaaatttagtccattaaaaaacaaatccaaggaacaaaaacctcaaattactcttctgatggttccattgaattccttgatccccacagtacaccaccagctagtgttgttctgacgtaattgtgtatgtgcagaaaagggaagggctctttaggcggaagggaacaacagctctgtcattaggatgtcctcagctgtgggtggaattggaggataggactcagaaagggggtgattagggaacaactgtgacatttcatggtgacagaagccaaaaggcagagacttctaaggaagaaggattcacatgttgcgaataaggccagtggggacacaggtactaagggcatcctctttggtttctcacattgcagtcatatggaacctttgagaggcagacaggtcagggtgagatgagtaaaccaggttacaggggccttaaggaacaagtgaatggaccggcgagatggctgagcagataaaggcgccaacaagcctgacaacctgagtttgattccctgggacccacatgatgggagaaatcgttttcgcctacaagttgttctttaacttcaacatattcgccagggcagttagttgtccaccacccccgccccacacacctgttatcctcacaacatacacaaaataactaaaaattttaaaaagcaagtggaaaatgttggcggccagtgtttaaaatcacaagatgatttaaagtttgtgaccagtggaaaaaaaatatgcggacggacagggtggagttggctatgtcggatttactgcctgctttgtacatacagttctggatgggggaaagccttcattccttcgaatgttgttaaaggccctttctcctatagcacgagccttaaatacgtactagccggtcctttcagggagctctctgacccctgactgtagaagcatgggcaaaagtgaggaagtgtttgttcctcgtttggtgtgttcagcagaagagctcagaggctgttgaagagcagagcaagagctgttagtgtttcttgctgtgtgacaggttgcctcaaacttactagcttaaaacgacaagtggttccatttcagcttctgtgagtgaggaacttaggagtccttctaggtgctctgcctctggatctctctcaaagccacattctttttttttttttttttcctgtgttggtaactttttctttccatttttattaggtatttagctcatttacatttccaatgctataccaaaagtcccccatacccacccacccccactcccctacccacccactccccctttttggccctggcgttcccctgtactggggcatataaagtttgcatgtccaatgggcctctctttccagtgatggccgactaggccatcttttggtacatatgcagctagagtcaagagctccggggtactggttagttcataatgttgttccacctatagggttgcagatccctttagctccttgggtactttctctagctcctccattgggagccctgtgatccatccattagctgactgtgagcatccacttctgtgtttgctaggccccggcatagtctcacaagagacagctacatctgggtcctttcgataaaatcttgctagtgtatgcaatggtgtcagcgtttggatgctgattatggggtggatccctggatatggcagtctctacatggtccatcctttcatctcagctccaaactttgtctctgtaactccttccatgggtgttttgttcccacttctaaggaggggcatagtgtccacacttcagtcttcatttttcttgagtttcatgtgtttaggaaattgtatcttatatcttgggtatcctaggttttgggctaatatccacttatcagtgagtacatattgtgtgagttcctttgtgaatgtgttacctcactcaggatgatgccctccaggtccatccatttggctaggaatttcataaattcattctttttaatagctgagtagtactccattgtgtagatgtaccacattttctgtatccattcctctgttgaggggcatctgggttctttccagcttctggctattataaataaggctgctatgaacatagtggagcatgtgtccttcttaccagttgggacatcttctagatatatgcccaggagaggtattgcttcaaagccacattcttatggtcacccatggctgtagccagatgtcattggtgtcactgaggtgtggcttatgtctaaacttgctggtgtggctctgaacgaggtcggaccttcttattcttgggattcagacctggaacaaacagatgaggtgcatatttaaccaagtggacctgacctccagattctcccagaatccctcagtccgtgtttattacagggcatggctggcataccctgcctctgtgctgaactttccagcccaggggaggggcttgctctccccccagaaggaggtcttccctacacaatccagatattttggtcagtctctttccccctccatccttctttccctctctccctccctccatcccttcctccttttttccctccccactcnnnnnnnnnnnnnnnnnnnntgcacagattctttctcttcccccccccccctcctctatctccctataaatggtgacatccctggcttcattccttggggccagtgaactcacccaagagctgccctgccaatacccatttttatactttaatttggcttgaactggctctttttgtcagcagagataacctatcacttaagattgcccaacaatgagtgagccgcaatgtcatgaccttacttttgaacttgcacatccccatttctgacaagcattgtctgctgcatagacagactaatgcattatgggaaaggactgcccaaggtcgtgatttccaggaagcagacaggatcgtggcgtctttcttgggctttgactatcccaggagagaacttgttacttaaattctctttgcagaaggaaacagtctctcctgcatttgcgttcagtgagaggtggtgagctcacctggcctgtgggagtgaagaggctgtgaggctcttactgagggaaatggtcctcaaggtgaggatgggattcttttgatgatagattcaccaacttccagtgaaagttctgtaactcctctttggttagggataagatggcaaggtgtgctaaccgtggaaatctttgggacagagtagggctcacaataaggtttgcagtgaccacaaacaagcccccccttagcctccacgccagggatttccccacaggtggctgactatgatttgactttctttaacttccctgccctgttacccacctgcttatttcagtaaaattggcaagatgtacattttgatctctaagatccgggctttgaatttccttcaaactctcgggtgagcggctaagatcaagttcacagaacattctgtttgggacacaactttgcctctggtggagaatgagacttccagtttcctggattggtgggagatgacaggggcctcctgtggaagagttgagcggccgcaacatcgaagggagttcttgtttgtttgtatgttttgttttatttcaaaatggttaattctccagtggaattttctaacgaaaactcagatacaagctggcctagtggcacacgcctgtaatcccagcactcaggaggcacaggcaagtgatctctgagtttgaagtcacgctggtctatacagtgaattccaggccaggcagggctacacagtggattctaggacagcttaaggctacatagagagatcctgtttcgaaataaaacaaaacataaaaactaacaaaaactcaatgcagccagtggctcagcattgaggcactctgatgacatcatgctgtcacctctagtctaggccttgtcatcaagcagggactggcattgtgctgtgtgtgagcagctgcgggatatgagaatgtgggttcttccacggggcttatatttatgttagaaacccctctttattgttagaactttccaacagatactgcaaaatcttctatggcaaaactaaagaattattgaatgagcaaatgtccttcaatactcttagtgccttcctttaaatactctgttaaagaacacgctgtcttccgtaggttattttccgagtctgtggcatgtatattatagcccaacaatgctgatgccgggttgctgtgtgactgaagagcactaggcatcaccatcatattttctgttcttcgtggagctgtggattctgttactaactaggacttattctcttaggtacccactgatggcaacgccgggctgctggcagaaccccagatcgccatgttctgtggtaaactcaacatgcacatgaatgtgcagaatggaaagtgggagtcagacccgtcagggaccaaaacctgcattggcaccaaggagggcatcttgcagtactgccaagaggtaagtccctagtggtgcatcaccggcattcactaaaagtatttactttcttacatcttatatttatattttctctcataataaaaatcctggttcctaatgatccactatacctttcatacagtttttctttactctgcagttcacacagttacatactgctctgtgctatgaccatcaataaactgggtaaaatttaagttttcacagtttactatgttctactgtgcctgtgtaataaagggataaaggaattaaaagtgctagatttaattatttatttttgttcaacctctttgacatattttagtacaactacaacttgatatttttctagctttttttctcctgtaatattgtatctttgaagtaaacattcatgctgataactctagaaagtatacagaaggtcacttccacttcatcccatgctgatgaatatttttattctttaaaacgtacatttttatttcttgtatatggatgcttgttttgcctgggtacatgtctgtgtaccacgagtgaggctgatgcctaaggaggctccagaagaggttgtcacatctcttgggactggaattaccaaagtacagttgtgagctttcatatgggggcttggagggaggattgaagtttccttttctgaaatgcttgtgttcagagtattttggattttatagaatttgaagtattcgaaaggtcatgttgagctgctttgtggatgggacccaagtgaacatgaaattcttatctacttcctgtatccctcacactcacaactgtaaggtcattttctgtggtgcttttcgtttgagctccttttggactgcagcctgtcccatgagatcaggtaggaatttcccacatatagattcagagcagctttccaaaaagtgcctggttttggaacatttccaatgtcctgtgtttggaccagagatgctcagtttccgtcttctttgcctttctcactagccctttttgaaagtaagccacagttgtcaaggacttttcctgccgctctatgacatgggaaggaagctgtctcttcaggtagctacctgtctgtaccctaagtttcccatgattccaaagtgctaacagtgactgactattccagtagacttcagcagaggccagtaggaaggctggacacactctttgtccgtgatggtgccttctgaatttctatgtgaatggttgttagtacctgtggatcatcccgtaagcccgtgttttccacaaatgaccacatgtttttaagcctatgaatattgatcctacaaagattattttccttgactgggaagagccctcacttcctgctgccctgagcccagtcatgcctgggtagcttcattttctgttttagtttgtggcttgtgcagggatgagccacagactggttctttccactccagactgcctgcttgcgggtagccatgggggaggagcaggggaaagccttttggcagatttcttctttctgccgctaatgtagcattcatctctccttgctcatcacctgcagtccattggacaagaaagggctaacatatcaagggtttgcgagccattttcatgaatttggtccgcatcctataacaatgaaaagccactgaagccattcgttggcttaatttttgaagaagaggagagactacgttggaatttcagagtcaaccctatccagtatatatcactgtagaacattccagacacctggtcccaagcccatgtgacggagtttccagtccctatgctttttgtacagcttgagcacttgaaatgtggccagttagatctgtactgttgagataaatgtcatgtttcagaaatgtaataccaacaaaggcatacaacatagatttcattttgaagtgactatattgtgtgtagttattaaggatgtcataaggatgttacagtcaaactatatggggttaaagttgatttcacctctttgtggtttttttttgttttgtttttttcatgaagctggaaaaaaacttgaatgtccactggccacttgtttgtatttccactcagcagtgctctcggcttgtccagtgtcactgtgacagggtcgtaatcaattcattatccggtcatctgaagcataagagagaaatgagctggggagtccccacagattgccactcagaaggttcttggaagcctttaaatcacattgttcaatctgggtgtggtggctctctcctgtaatccttacactggcaaatctgagccttagctatagaatgaaatgtctcaaaagcacaaatgagggagatagagagatggcagagggagatagagagatggcaaagcagcttagagcacttgtccgtctctcaaaacatgctggtctgattcccagtcccacttggtggctcagaaccaaggatagataactctagttcctgatgtttgcataccctcttgtggattgcatgggcagcaggcacccatgtgggtgcacatacatacacatgcatacatgtgggaaaaacacagatgatataaaaataaataaatataaattagtatctttaaaagaaagaaaatcatcttactagaatgtttcaaggtgtggagaagatataagagccagtgtcttcctctttgagacatttgcctctggatggtaagatctccgtgtagacccactaattaacataagaggagcacagctccagacccaaggtcttagtgctgtaaattgacagggcagaggtgatgatgtcaccacttgtaatcccttttcattcttaacaaagcctcagcctcagggccaagtgcttctgtccctttaacccacttagtgacacttctggaaaggagccttggaatagaccttggggaaatgcaacatttaaggggaacaaagagatgctatgaagtggccagagacaggaccagaactggcatgtgtcatgtgctgggagacaagctaagttaattgctaaacagagaaaaatgatgagacaagtatggtcaaaaatgagagcgactgaagtgtgatttttagcaaggtcagcgtgtgcctccatgaaaactgaccacatgccaaaagcaggtcttcagtgcacttcttaaggggagaagagtgtaagcttttcagactggcccaggttgacttggataggggtagattcttagcacgtttcaattgcatggatgtgaacagggatcaccagcaattatttccataggctaggaagcattgacattgctcacagggtctgtgcccataagcctataaaatcaccactcaactctaaaacagtatccctcaaatcaaatcatctttctccgactagctttgggtactggacagccacatctatctgccttttactggctggatactgccttttattaggcagaaaggttgtcttttcttctttcttcctttctttctttctttctttctttctttctttctttctttctttctttctttcctttcttccttccttccttccttccttctcttcctttttgtttgagaaaattaattttgacaaaggacattacccttaatagagacaagcctaattgctacaaatatgacatgaccaagtggcgaggataattatcactctgaggaaaaaaaaatctagataaagagcttgaggtgaacagaggcaaaggaaaccatcttcgctttagtatttatttattttttgtttgtttgtttggttggttggttgattggtttttaatgatggcaacttaagccaaaggagactgaagccaaatcaagggaagcatagttgtccatcataaatctcaggtgtgtgcagaggaggaggctagatattgcattggacacagctatgctgtccagtacctgggaggctaaggcaaaaggattaaaagtcagaggccatacttggctacactgtgagattctgtgtccaaagagagagtagggtgagccgaaagatctgaaggtgaaaggagactccgctgaatctggtgagttttggaaatggcaaagaatgacctttttccaagaaacggttaactaggtaggttctgttgcccagagacaaaaccaatggaacagcccatgtgtgtggaagagggtttctcctacatagagaaaaaccctgggctgaaggcagctttcaaagggaggaagcaggactaggtcctgtgttggagtgttggagcagagaactattcccaagtgctacttctcctgttaatgccgttctttgttctgcctttactcctcttctggtgctaagatgggtgccccttggggctcaggaaggtcggaagctggcagccagtgcttctgggagtggcatcccaactttgtttgccattgtgtattgtaattccagggagaagggattctgagtggcttcgtgttgaccacacaaagatttggcgcctgcaccagggtacttacccatgtggctgtgtggtctggcaacccacaaggcatggaagaatggctgctcacagaagagggagagaaatgcacaaggccaaaacggaatgactgtggccctgtgtacagtggcgacagagctgggtagttcttttggctgaaagtgctggctgggatccacattgggtcttgactttaactggcacagagaaaatggcagagtggctggagatgaccacttggggccgttaaatgtagtttgacattgcctacaagatctttcattagtgttttagtgtttagtgtttagtgtttccctgccacttcccacattgtagctactcctggtatttttaataaatagctctgatttatagatctgaattttttgtatattttgctagaatacatttctttgcttttattccttctttaactatgtttatatattaagtgacattgattgactcattgcatgaaatgaaaaggaaaataatactcaacaatttttgctaaattataatatttttatatttttaaggttgaatattaaggtatgttctgttgcaggaattcccatgtcagatatttcttttcaacaggacttgtttagagctaatgcttccagccatgttctaatttctgtattacttattaggctgttatactgttattattattttgatgacttttgccttaattagtcatttgcaataattttgcttagtaccataaaggtgatctcctttttgccatctctcattgcacagattcctttgaagaattctttgcaaccctgagaccagagttctacccccagaactcattgtagaaaaagctacatgtgaagtacaattataaccctagtgttggggagccagagacagacaactggtcaacctatcttacttagcgcattctaggagaatgagaaacccttttcaagggggaaaaaaatcaaaagatgaatggcatgtgatgaatgacacccaaagttgtcctttggccaccgcacacatgagcacacacacacacacacaccagaaatgatctctacttattaccagtaacaggactaaacagttaatggttttttgtctccctgtaatggtgactttattttatgcatggactctaacctcccaagactgagacacagatgttttagaagcaatctgctgagtcagagaggcagctgttagcagtctgagcctagggcagacaggaggagctgaactcatgactataacctcattttgaccttttgctaaccaactgaattttcctgctaaatatatctgtaatagatgcctttaactgtttgctggtgcttagcccagggtggtatcttaatattgatccttttatggggaattaggtattaactagtttatgtcctctgatctctctcactcttcttggcttatcttccctgctattgacttgatttggaagtctataagagtggcatttatgtccctttggttcctttggagctatccttggtcaagggaaagaccgaggagaaacagtaatggctgaatattttacctctactcctaggtacacataaggccttatgaagtttgattgagaaaatagttttgattgtatgacctaatgtgtatgtttgttttagccacatgttgaccaggtcttccaaatgtttgatgtctatatatttccttctgtccccagtcatagtagtttttcttctacccagtcattgttgaagtacatgtctctctcttttatttctatgctttttattagctccatgtacagtttttcttcagctccttatcaagcacatattgagtgctgttaaccaactgaacaattctgcattcccaaagttcataggttaggctaactctctttagataggttttggagacacagtctttcagagatgactagtattgatgacgtcatgagggcagagccctccagatggtattgatgcccttacagaaactgcagagagccagctctctttacttcctcatacaaaggggtcatgtgaggatgcagtgtgaaaatagaaaaatgtcctcagcagcacattcggacttggttttgtcactttcctgaactgtgacaaaatagatttccattgttagagttgcccagggtgtggtattttactgtagcatgtccaccaggaccccattatgtctcctgtaggtaaaggctctagaaacccatggtgctacagagagtgacatttttagggtcatgattcacaaagcattttatctgacaactgaagcatgctggtggccatttggtaatgctggtggatgactttgttagcatgagactgtagtaggatgggcagaggcatccttgtctatcctgagggagagttccctgcaggagcacctgtggtttctgcctgaggggccattctgttctactgttcctggttttaaagttgttagacaagagtcatgggattgcacagatttggcctcattttatatacccaacaaaaagtgcaatgagaggacctgcaaccttagagagaaacacagagtgtagctttaaaatgctttaatattgtctgtgactctttgatggaggaaaatagccttttctatgatcaatactagaagcagagtgctaacatggagaaagatacttaaatgtaacttcataaatttaacaatataacaatagccatttgtgctaatgagctgttggggtaccatggcaaatgttatggctgaagaaatgtcaaaatagaaaaagcctcagagaaacaaatattatgtattttctatttgtggttcctatgcattgtatagattcataaaatcatgtctgtctatatgacatgatggtatcaatgagatgtctaagggaacaagaggtgacagtgggtggtatagggtagggtaaggtagggaaagctatggaggagaatatattcattgtactgtttaaacttatgtgagagctctttatgcatctgagtgccatgtacaatggatggacacactcaaagctgtagaaatattaaaaataagagatcaaaaaccattaaaatttagggtcagaaaatgagacttattaggtttcattgcatggctttcaggtgaaatgatattttttttaaaaaaaaaatatattgtttcatgtacaccaaaggcttcagggtgtgtttagttccacgtctcaagactttatttctttacttttaagccaggcaaccctggccagcgtagctaaagactaccgaggatagggctttgtgtcagacaatgcctttcctggcttacaaggggtgcaaacatgctctgttccatcagattgagaataaaacctagaaaatggagacagtggtaggtagcaaggagggtcttgatggtgatgtggagactctggatccaggttttgagagatggaagccaggggatgtgttagtatgagtgcttttagtgagacatttcagtagtgtgtttcaaaggttgggctgactggggagagaatttattttacaaacagaggtgggaaaatggatgtgaaagatcatcctctgaattctgtcagtgaccccatggtccagtgtatgaagtaccatgattcagggcaatccacaaacaatgtctcagactgtgtccttcctgtgtaaccgggacaggcagatgttatgaaagccagttgttatgagaaatcatatacagccttgatcctcctctgtccccctctggtcttaagcacacaggaaggacttttgctaggcaaagcttcctgaaggaagggttggctctttgagcatccacttggagccagcctgtggaggctggctgaggatgggaaaagtttcaagtgtaggtagtcagatggacgcacttggctttttgcatttcctctactcttagattattcacacattcttaagtaagtcctttatattcatgacaatgtctgtgatttctttatccttgttcctctatttgagtgctttctttgggattaacaggccctcaaaacaaagtagtcctgtgcagaagcaaacaaacaaacaaaagctggctatatgaattgaaaacagctctttcttttccctaactttctattctaaaatttattatataacccaatgtgggattcccaggaagagttatttctctttctgttgtcattcttcattaataggaaacaaaattgttaaaaagacaaaaacagtttgtcctcatcaatctaactgtctttcagggttgccctgtgataaacagcatccccgaaataaacttggtttgtttcagttcacacgttacagtccatcactgagggaaactaaggtaggaggaacataaggcaggaatctagaagtaggaactgaagcagatctgggccatggaaaagtatgggttactggctggcttgctccaggctcctgttcagctacttttcttgtctagcccaggcccacctgcctagggatggtactgcccacagttccagggtccccctgtatcatttaacagtgaaaaaaatgcccatagacatgcctacaggccagtgtgttggaggcacctctttagtggaagttccttcttttccagttcctaggtttgttacaaatggatagcagatgctataggagtgtattctatatactgttgtttctctctggtcactttatgtgctcaaaattaacccacagatcataagcgtcatagtcctgatacttaaaaggtccaagaattcatattaagtaaagcagttttttgaatcggtggatcataatttttgaatatgagtactggtgtatattctgcatcgatggtctatttggattcaaggactacttggaacttagggctaaaagagatgaagtcagtctaaatattgtaacataagaattatagtgagggtgtgtgtcttagtaagccttctgctgctgtgataaaaccctgaccaaatccaactagggggaagaaagggcatatttgatattatactcccaggtcccactccatcactgaaggaagataggtagggcaggaacttcagtaggacctgaagcaaaaaccatgcagtatcgctgtttgccggcttgctttccctggctggtgctcagccaactttcttagacaacccaggacctctttcctacctggggttgcatcaaccacatcaatcaacattcaagatggttccccacagaccagtcagtcaggcaggcctgggcaatccctccagcgagcctccctcttctccagtgattcttggttgtgtcaagttagcaataagaactgacagagagaaaactgatgtctgaatgaggccatgtgtgtacgcatgtgtctttgttttcacatctgtgacgtgccttacacgctaggcatcccctctttgcttttctcatgagtgctttggaaaggcagcggcataccagccaaaccaggctcctccgtgccttcccgcaccaagtgtgaatgtgcggctagaacaacacattaatatgcagtgtcacatgcagaattgggccaaatggttgggaaacacactcttgccttgcagcgctttgccttctgcctcgtgcaaggcatccttgtgagagcagggcccactctgctcccctctctctgacattgcagacgtgtttcatcagctgcctgtgcctctcagcacctcattaagtcacgagcagccgccacttttcggcttccatttctctttctcaactgaattagatgttctgttttctatatcccctctcattagcagaatcgaggcggaaaacagttttaagatgcagttttttcatcaggttctagaaactttaaagtgtgtcacttaaatctggaaacagaaatgtattctcttccgcacaccccagtcttggcttacacacaccaaagtttaagcagcgaagcgcgtgctgttaatgtggtctccgtgtgcttagaaaaggcacctgcgatagttgtcaatccgctgtgacatgctgcccaggagatgtttgcagtgatgtctgccattggggaaacctttattatgatctggttttattttcttcttgagcattctcttcgtatggttcaacctcatggaccacatcagttctggacgccatagtttgctatgcctacctgtgagctaaatgtcttgaaggaagcatcacaggttacatatggggttctggtgtacagacttaacagttcctgacattaaaaaatgatagagaaacatcctttaagatagtactgcatcctttaagatattttattttaagaataaaaaccctgactaccgatatcatctttttgggttgttttggttgattttttttttttttttgagataggtttcccctgtgtagctctgactgttccagaactcactctgtagaccaggctggccttgaactcgggtatccacctgcctctgtctcctgagtgctgagattaaagctgtgtgataccaccttgctgctaccactttttatagggaacccaagatggtttctacatgaccatttttctggcttttggtattttggaattttttcaattctctatttaaaaataattttatagactgatacttaatcctttaatgatatggcatgattctaggaccaggtaaatgggcctttaaaaaaaattgtggatttaattcttccaacagttcatcttcagctgtgtattattgttagcttatttcaacccaagatactattagaagtataacctaccacctctgtttagaagaacaacattgagagaattatttttctcaaaaagcataaaaccaagtagctgtcttatagtcattgggcctagcagataggtgtgtgatgcccagcaagagtgtaagacatgtaaaccatttccatattgaattgtatcaggacttaaccagaaataacattaaatatttgtcagacattactgtgctggcatagtgggaggggtggtgggtggggactccaactgcaccgcatggctcttgccttcaagaaggacatgttccagcaggtgtctaggaggtaggacacggtcagttgccaggtgttgtcagtgataatagccatggcatgaagtggccttgttccagaaaaagaaggattcgtggaggggcatttgtgaaaccagcaaataaaggggtccatttctactcagctgaaaggaacatagcactaggttttaatgtatctgagggagatatactgtaaaggggtgtttcctagaagctgagtgcccttgttttgagtttcggaggctcggtgctcttctgcagcttctctctctgcacctcttcctatttacctcccctggattgccctggctcctgctgggcaccgtacacctatccaccaagcccaatactatagccagctacttgcttttatgctttttgaaaaaaagcattgtcatcctgatgactggcttccccgcctttgctctggcttccccgcctttgctctggcttccccgaatacccagaactggaaccacaggtgttttccagctaccatgttgatactaggaaaggaacctgggtctcctgtaagatgcaagtgctcttaactgctgagatatctttatctgcacccatcaagtccatgattttcatcaagaaagcaaccgtacacacaaaacgtagcaaagaaaggaccacaaacaaggattttttatgtctgttatactagcgttctggtacatacatcattagtgacagttgtcccactaacagcatattttcgaatgtaaagtacttgcaaattacatgtaatttgtaatgcatgtgagaattgaggactaatgtccaaagtttttctttaacttctaacaacttcctgctgtttaggatggcaaaatattattctttttggcgattccagattaataatccttcatctctgagtaaaagtgactgagtcaggttgaagttgctgcatccatgtcacagatcagggaaatcagacaaactgcatgtgacatgactgacatatgccagcagtcacatacaggactgcacctgtacacattatatatatatatatatatatatatatatatacttaaacacacacatacacaaaactcatggcatctttgcttcctttattaaaatttactgtgtcacaaaaatattaaatgttgtcctgtttcttgtgattaaatatgatgaataattaaatattgttacaaggttatttacacattataattcacttaatttttgttttgttttgcttttttgagacaagtctttctatgtattcctggtagtcctaaaaccaggctagcctcaaactcatagacatcctcttgcctctgcccctcaagtgctgagatgtaagatgtgtgccaccacacccagataattcagtttttattcttgactaagacagtgcattatgtgatctaatctatcaacaaaaaatgcaccattgtctctatagacttcttctggagctacttaaacaagcattcataaatttttttttgtaatttttaaaaatataggtgtttcgttgtgtatgtttgtctggcattgctttgttggggtttgtacctgtgcaaagtcatcacattacctagctggccattcagtacttcaaaaggaaatgtactactttaatttttttttaaaatcatctttttcccctttaaataaacttcctgctatttagaatggcaaaatattattctctttggcgatcccaaattaataatccttcatctctgagtaaaagtgactgagtcagattgaagttgctgcatccatgtcacggatcagggaaattagacaaactgcatgggctttatgcagttcgggttttataatctctcatctttctgcatatgaacactgctgtcagagcatggagggaggtggagaagcccagggagtcacatgtgtgtcctagattctctggatagaattggaaattaattgtctggctgatcgccattcaaagctctggtaatctcaagggagagccacatgttcacaggtttggtctgtcagcttgccatcttctctgcacagacactgggcaccgaaagatttactggtccgctgcaccagatattatcctaggagtctgatggtggtgtgtgagcaatgggagcaaggaggccccttctcctgctggtccatttgtaaactcaattccttggttgtaatggaaaggaaggaaatgtggtgtgactgtattagaggaatttatagaaaaatgacgtctaagatgcgtctcgtaggggcagcatttctaaagtgccagctgggttccctttagaaagatgcagtaactcacacttcactgcacataaagtcctatcccccagggcaaactctcatgccatcgagtttatgactcacaagtgctgtttgtttgtggtctaataaacaagaaaaggtgggagaattatatttctgtacacaacgctacctgccctccattatagagaataatgctatggggctcttaaatttttagtggcattttcaaggggagcattgcccgggccttaaatgcatgtactcacgggttggagatacttaagcacaaaaccaaatggagcgaaggtagctgtgccctttgcagctaaactgctggtcgtgtttgaagaacagggctctgccttacagacgaaactaattattacattttgatgttctcttgtttgtgcacgcatgtgagtgcgtctgggtgcacaggtgccaacaggtgattgctgaagattgaactcaggccagccggtgccttcatcagctgagccatctcactgtccccgacttgggtacttacgtatttgtttagccacatgattcctctgattgataccttgtgttttattatttgagaatatagttcctttttttctttgaaagagaagtcatacatttaccaaaaagcataaaagacagcagagagatgcagtagatttctcttatcatgaagatattctaccagaatgagccagccctgacaaggcatgaacccacactgtcatgctttgtcgctcacagtctatagttggtcttagggcttgctcttggtgttgtagctcctatgggtcagataggtgtgtgtgtgtgtgtgtgtgtgtgtgtgtgtgtgtgtgtacagggttatacctacagggatatgggcaagcatggacaccaactttgagtgtctattcttcaagagccatctcctttttactttttgtaagatttatcttattttgtctgtgagaatgttttgcctgtatagatatgcaccatgtgtggtgtcttttatatacaccgtgtgtgtgtgtccggtgcccacagaggtcccaagggctgctagatggcatgacactgatgttaagaatgctaaccacaatgagggcgcttgtaatcacaaacaattcctctgcaagaacaataactgctttttgttagcctgagttgtccttccaggcttatcaccttgttttatgagacagggtctcttaggcaaggccaactgctcaacgagtctcagggatctggctgtctccatcttcccagctctgtaattacacatgagcccccaacatgcacagttacaggggattcatctctggctcataggcgagtgctttgtccagacactgatcgttttgctgcctgtgtagagaattgtctttatagactgtcatgtctttataggaagtcataacagtatggatcctttatacactgatttctgccacttaatggtaggcatttatttcagttccctctgtgtattttcttagctagatggatcattttggggggagaggatactaaatatttctgtgtccacaatgtaattatgtagtttttaaatatccattttcatcgtcctgtctttcttcctttcctttcctttcctttcctttcctttcctttccttcccctccctttcctccccttcccttccctttcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctcccttcctcccttcctcccttcctcccttcctcccttcctcccttcttttacaaacatcttttacctcacaaagtaaggtgaggtaatcaaggcataagtaatatcgttttatagtatttcaattagatgcccccctccccccataactgcaatggacaagatgtcagcatcttaaatgaagacagggtcactctgacaatcacaaacaaagtaccgcggcgtatccacggctcccaggtgggcacggtgctctagttcaggttcctaggttttctcagcagtgtgcgcagaagctggggatgagtctgttccgcatctccagctccacacccctccccctccccccaaaacccttaaacctgtctatgaactctagtgctttcagcctagactgtctttgttgtctatggatggagttgaccctgagccctactagcctgtggtacgcaccttcaatctttgaagtcttctgcttctggcttcctgtcatccattacaacccttttgtaggctgtagttatctgggaggagtcagtgatacctctggtacttccgtttctcaaacccacatcatgaatccttcagggacattggcttctttttgttttgttttaattatctactccctttgatggccatatttatattccttgcgattaccaataattgggactttctcagattcctaattttaattcccaaactctcccaagcactagtccttcctggctcactttctataatatgtctacaccaaaccctttagcccattccagaattcgaatcctgttgtcttacaaccttttgactgtgtccaattcccttcatgttctcaccttcacctcctggattcatcacctccagttaaactatctgcttccttacagcctttagtaaactatttccctggttatttatctcgcaaaatggctcactttagagccatattgtgtattgctattcttctttcaaatctctaacccattattattattacatagaagtggtttgatatttcacaaatacattttggttgattgagtttgacatttcgttccaagtgatcagcaaacagcatgattcatgagcagcagtcatcacagacagagataagtagtttattactgaaggaggagaattcctgagtgccgtcctttaaatggctctcttgaagatgcacttaataaaatatttttgtgtaaactgttttgaggacagaggctgattttttttgtgtgtgtggaaaccatctatgtgccatgctctgtgcatgaagtatttttcagagagcagtgagttgaatataagtagagatgacaaccttaagtatatcaatcccagggtttctttagagtactacaagctgtggtcttccctagtggtttattttgcagagaaaatgacctcatgctttcaagagtctctgctttcccatggttctagtttaactctcctggacagtgtctgaaaagacagctcgatgcaagtcaccttggagtggaatactaggtacagccgctcaggcattttcctttgtaccagtgtccgtgcttggccagaagcagagcaacttggctcttagagaataacggaacctttgaataacagcgaaggttcaacatgtactctgtgtgccagccaggctttgccaagagtaatcatttcctcttctcctgtgttccccaggtctaccctgaactgcagatcacaaacgtggtggaagccaaccagccagtgaccatccagaactggtgcaagcggggccgcaagcagtgcaagacacacacccacatcgtgattccttaccgttgcctaggtgagccggttagccagccacccccacagctcgagctgaggggaggatgttgtaattaggtcatattcatgcatgcacattttatcagcatgtcactgccaacatattgttggtgccatacctttgagtttcatatctgcagattcatccaaagatgggtgggaaaaaaaaaatggaagtgcaaactccaaacagtcctgtgtctgtccttatgtttcatttaaattgcattagatattggaagtaaggagaggcgatgtatttgtttcttcattatttagtgtggtgattgagaacaaacataggactttataaaggttaggtgagcattctattaataatgtgtatcccaagcctgggggaggtgagttaaagtttgtaagcacttgtatgtaggctgtaggagaatactcattttctatgaggcttgaggttttagtgtccacaatgcatgaaagggcctccctccctccccacaaataccatgggagtgtatactactatagtttggatggtgcaggtactgccctgtgttcttttaatacaagaccagcattccttagctctctgcttctgaatagctttcctgtctcccagccagtccctggtcttctgagtggaaagtgtctgctggtgaaaccccagagacttgcaagggattctcgtttacactgtccagtgttacaaatggcaggccttgtatatttcctcacaggatttcacaggaagactataatgtgaggtctccacactctagctaattcctcagaaagcccttccctagggcaccccttgttcctacagttgaaaatgatcaggaagtatgtttgctggattgtttgattttatatttattcagatcgaaccgaaggaaaccatgtgttcacaaaggcctgaaaactctactttcatttttatcttaaaaaatggagtcctttttgtcttttgagaaagccatcttaagtccattttcaatcttgtcacaccttcttcctggcatttcatgtgaacaagcctgccatagctagccctgtttgatgtgataaatcccacttgaatgtttccattgttattgattaataagaaggttgtaagaatggagatctttatatggatagtgatgactttgaataaagtctaaaagaaatcttttttagagagtcaccgttccccttccaggtacaaggaggtgagtttgcattccaacactttagctacaagggctccaatcaaaaccttgtaaataaagataaatactgaagactctaggaacttgtatagttttgtttagctgtggattccatagagcatactggaagctggtggaacagctctgcagttaagagttcttgctgctcttctgaagaacctgaattcagttcctggtactcaggttggatgacacacaattgcttgtagctagctctagctccaggagatctgacaccctcttctagacttcaagggcacttgcgctcaaatgcacctcccactcctatttttatatattctttcaaggacatgctgacgtctgcttatttgcgcatgtaatttgagacatcaacagaaaacatgggccattagaatgaagatctcacctgtgtttcatattcagtaagttaacaatgaagacaatgttgaaccagatgcttgaccatttgatagtctgtgtattctcttacactcccttattcctttaatcccttattagctctttaagtatggttgagaagtcaagatttcataagagaataataagagccagattttacactgtgggcacataggaactatcaaaatcttagttttcattatgataaacctcattatatcattcagggacagcctcactaatttgccttttagtcctagtttatgtagcaaacaccaattagtgacctgccccctgcttttccctcaactgttagagaacgatttttcactggttgaggtttgtagagatgtccatacaggtcagacaggggtaagagaaagtggagaggtgcctcaaaattgtccaagagatcctgtgaggaaatgaggaagaccgaattccctgctgcctctgtcttcggcaaggaccagatttctcttttatcttctaaatagattctgagctcctttgatgttgaagtacataattcaaggaggcaggccacttgtaacatgtttagaaaatttcccgggtctggggcagcatctgatctaaatcagcacactgactctaactgttcctgactgctaatagactagatgatcattagatactcccagcaggcatttggcctgtttgaatcttttattgtgtttctcctataaagtccctggtcttttcccattggatctgaaacaaagggtcagttgacaggcagagcatacctgtctcttgctttgccaaagagcttagattagaattaagcaatgtgaacattgtcaatttcttaggcagtggcaaaatttctacgtgtctcagatatgttacacaaggcatataaaatgcgctgatgtgtatgtgtggtgtatcttcagttttgagaaaaaggaattacagaacacatataactcatgtctattgtttgcatgaacattgtaagttgcacctcttcacctactgtcttcattccttccctccctcttcccctggcttcctgatctgtccttcatcttgatgtcctgtcattggtggcatgggtcatccattggaatggctatcccataaggttgactctgttggcctcccttcgggagtataagtgttcattgctagagaagttggatttcttgatataagtcacacagccatgatgtgttcagatcaggaccagagcccacaatttcttgatttcttattatctgtattctttataatttttttaaaagaattaggcctggcagtggtggtgtgtacctttaataccaggacacagaagcatgtggatctcttgagttcaaggccagcctggtctagagagtgagttctaggatagccaaggctacacagagaaaccttgtctcaatgcctgccacatagaaaaaaaaagtattaaaacaactgtccacttggtttgttaattcaaatcatgcaagaaaggttgtgaatttgagacaataaatattaaaatccacagtagatatcatgttgataaaggtggcaatttggacctttggtaaggaatgattgggagttcaaattttttctgataattacagaggtagtcagtgacttccttctctataatttgcttctgaaacaaagaattcttgtttagcactaatctacaaactctctgagacttcccgctgtatccaaatatatattttagacaaaggagagttttactggagttaattcccacaaagacgtgacctaaaaacaagagtaagattgtcttagacattgccatattgaaattcaaaacaaatctggagagagacgcctgccattcctggcttgtgacctcctgaccgctgcctgtctcagatgaaggaccagaatggcatgagctgaattccctctataggggtgtttgcctcgggctcttagctctgcactatctctctttgctggtgagatggggaagtgtatcatgttacctttggcaccgttctcccatggaatggacggcttccgtcccttgggaaggaaggctagctctcctttccctttttatttttcatacttccagaagcagagtataggatctgacttgatcaagtaaacatcttatcatgtgccatatgtgtaatccaaagcacatcgttcatcgtccctcagggaagcggtcggtttttgtttttgctttttcgaaccttttccatttcagtgacttctctctttatgggataatggatgcactattgaagttggcacacttctgcacttgtgtctgactagtagtgccacagtatgttgcctaagataaatcactgttgcttttacagggccaaagtgcagttagtagtgtaatccaaaagaggaattagaagttgaggaactacgaggcgacactgcggtatgcccctgttgctaaggaagataccccaaatttgcaggttgtaatggccttgtgcagaatgagaaattaaggttccattctctgcattttgaattttataggtttaataacattataagacaagtctgccttagttcctagatggctgcttctctgaagcatctatagccatcttggtcttctttaggtcaaatagtgtgtatttgtttacttgatagataactgtacaacagatgtgtcaacttatgctcaacagatttttgttgttgttgttgttattgtttgtttttttaaacatattagccaatggtaaaatgtttaagagtaaaaatgttaccaaagtgtgaaagtaggaaagaggatggaaaaacatttgttttagactttaaatatcctttaaatgtccagaaacctaaatgttggactccagagaatttatagatttaacattttttttcagttttaatatgataaattagaaattaggtaccgtttttcctgataatgaatctacaaagtactcattaaaaccactttagttgttttaaaggtaagaattttatcaagattactgaaattgaattaatgaagatattatacttgactgataaaatactgctggccagggtaggagatgataggcttttaaaatcattatctaaaaaataacctcaagaatataagaattaacatgacataacagtgaatctaaagttcaagttaaaagacagtttagtatcaatatcagctatggcccagcatggtggcccaggcctttaacaccaatactcagtaggcagtggcaggaagagctctgtgaaatataggccaacctggtctacataatgaagtcgaggatagccagggttgcaaagtgagaccctttctcaaacaaagaatcaggaagggagggagggaggagggagggagggagggagggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaagggaggaagggaggaagggagggagggaggaaggaaggaaggaaggaaggaaggaaggaaggaaggaagaaaggaaggaaggaaggaagattggttggtttaaacataggtacgtgcagaaggctctcattatttttctctacaatggagagaaattcaggtctttttttttttaaggtcatggtagttgccaagtagctgattaaacattctgtttttttacataccccttgatgaatttcatatccccaatgatgtgtcccaggggccccttctctgtccctcttcctagttctcttttcctgtgagtcttcagctttggctttgatccctaacagagaaggaaagtcccaacgcagcagctgggcagcagcagtctggagagcaacgagggaagattgcagaagagtggagggcatcccagaagtggggctcttgaggaagagatgacactgatggatgacctgctgtagagtcccagcttggccccttgtgtggctttagagtcctctcacagagtttgggaaaggtatagtgccgaggaaacataggaagtgaagcaaattttaaagtgtgggctcttactacttttggcaaacgaaacacagaacataaaaataaataaataaataaataaataaataaataaataaataaataaatacagcaaaaagttattttattaaaacacacagacatcagtgtgaacagctatgtcatctgtgttgttggtaggctttctgtggagctccgaggacaaggctcttagtttagcgcgtgcagagttggttggcccaattgttttgtgcctatggtgaggtaaggtggtgataggaatacatggattacctcatggccagcaataaaaagtaatgggagaggaggaagctaggggcttctcacacctctcttggagggcaaggccaccaatcacataacctcctctcacctccaggctccatctctcaagcattctgttaccccttttagtacctgtctcattggagagacgttgaagatgtgatcttcactgcctgtcttgaggaaggtaccacatgaggctacgctggtaacgttggtgtgaagagaaggcaggagacttaagaggtggtatcacctcccgctttggggagacttaaagtggagaaatcactaaagcaggtccttacccaagtcaccagcactaacctgtccccgtggacccccatagatccctttcactggggttgcttgtgcgagtatggatcagggcttgatgacgggagtcttaccagtggctacatcattaaagaaaatgtctcatctccccgtttgaatggcagtcaactgtgagagcatcgtgtcaggaaagtattacatcagtgaattggcgaatctgcttagggaaaagaataattgcagggctatattaggaataaatacttcatggggcagaagattaacaatgcttcctcgccatgcttttgcattcggagataattggtttctgtgtgaaatataagctctttggtgattaggacttttgttcgctcactgaaaactcccgagagcttagaacatgtcacagccccttagttcccgcttgtcaccatgtattgaaagaatgaactgaaggtttaaacgaatgggagggacagggagaaggagggacatcacttgaaaggcagaagacagggagtggaacttctcctgccaaacacttcctaaggtgacagcaggcatcagtgtccttatgtcagcctatgctgatagcagcatgactacagtcagccttccaggaagctcccttggagtttaccagttgagtgatttgagctgttttcatcaactgccatggctcttatagtaagattgtagtcagaattcgaagttgagtttaaaatgtatgggtaccaaatgcatccttgtattttttgaaaaagaaaaaaagaatctattgtttggggctggagagattatagctcagtagctaagagctgttcttccagaggagctgggttcaggtcccagtacccttttggcagcttactgctgtctgtaactccagatgtgtctgtctgacaccctctttgggcctctgggcattcctgcacgcatgtgcttcactggtacacatacacacactcaggcacagagagagagagagagagacagagagagagagagacagagagagagacagagagagagagacagagacagagacagagacagagaggcagagacagagaggcagagacagagagacagagacacagacatacgcacatagatagatagatagatagatagatagatagatagatagatagatagatagatactatatatatatatacatataaacaaataaatgttttttgaactgtaagagaaaaaatattactgtgtgcgtgcgtgcgtgcgtgcgtgtgtgtgtgtgtgtgtgtgtgtgtgtgtgtgtgtgtgtgtgtgcgcgtgtgtgttgtgtcatggtacaactgtggaggtcagagaacaactttctggagtcagttctccccttttgtttattacctaggtttcttggtgagaatcgagtcgccaggcttgcatggcaaacactttaagctcacgagctaggccttgagcaggccttgcaggcctgcgtgcatatattttcctcgagatgttctttagtcttctgtctcccttttgacttgatgaagacctttgccccacggcccgtttgatttccgttatcactactgtgtaggcttctcgggctttctttgttcttcagagaactcttggcttcgtgtcagtgtgctgatcgcatgcatttcttgagcagacatctttgctgtctgtccttcacagttctgcctcctgatctggtggttagaggtcataggagggcctgttagccttcgactcttttgcagtcaggcagcatcaggagtccatgtctccagctccgtttatctgtggaatcactgatgctctgagcacagattctcttgattgtagtctttgccttgctgttccttctgtgcattccttcattgttttccatcacaggctctttttgtagacttcagaaatcctaactactggtgtttttctacagcctttctccctggtcgttcattttgtataactcacatgcttgccagaaaattccatccatgctgtggtttccctaatagccgtcctgagttatcatgcccaaggccaggtttcttctctaggaagagtctcagatttggtgtgacctctggagtactggcacatagctttcttggacatttcaggagataccggtagatgccagttccttatgaagaaatgctgggcagtggtcgagcatttgcctgccgtgagtgaggtcctgggttcgagctccagcactgccaaatgaaacactactaatagatgataaatttgagatttttagattaaaccgtgcttaaacagtatgctatttttatcacttaatttattgctaaataccatttgcaatgattacaatttgtcataagagaggagtatagttattctcagccttctgaaaactatgcagataggtatatctgtgcacatgcatgaatgtatatgtgtgtgtgcatgtgtgtggtacatactcacgagagagagagagaaggggtagttatgagagattgagaagggctggagaaagcaagaagggagggtgtttgtgcatgtacaccccctacgcctgttcctttcttttatcaaagtctccaggactcttggttccttgcttaagaactaattaagtccatgtgaactaggagtcctgctgccaatacctggcaagcattcatggcctgatttttaatatattttaaagtggtactgtgtaattaacacattcttaaattttgacttctaaaaagcattttggaatacttcggtataaatataagattggttgcaaagtattggttaaaaatatagatgtggtctctagtttagaatgatgttattttatgaggagaatttaggactgtcctaaagctagggaccaaggatatggctcagtggatagagatgtttgtgcataggatgggaaagctgagttcagggcccacatcttggagagaaatgacctttgagagttgtcctttgacctctacatatacttgcttgaattctctctctctctctctctctctctctctctcacacacacacacacagagagagagagagagagagagagagagagagagagagagaaatttaaaattagagctgaaaagacgaaagttaaatcatctgcaagcaaatgcagaggccgcttgctgagggaatgctaactagagttgcctaatgaatcaaaaaaatggcaaatgcttaaaattcaggaaaatacagataagacctattatttattgttgtagttgaatattctgttgagatgggactggttatcaaagatgtcctttgtactccacgtggcttttcgaatgtcagctctattttctcagagagatgggctactgtgtctaggcttggagatagccatatagcttgaatagaaccccagacgagctgatcgtgcagatgtcatgtggcatccactgaggtcaagaggaaggagtggctttgcctttattttctttattttcctttctgatgaatgacctcaagggcacacttcatacaactttaagcttagaccagagaactcctatagtctgctaaagtggatgctgttggaagggctgcctcactcacacttcttccagaagattctgctacgtattgtcagtttgcctcagtgtttttcctacaccacattcctggggtaaaacaactcagatctgaatgataactttgcttgaatgcatgttcgtcaacaagaaaggcagaaatcataccatctgaaagggggtatcccctttaattatttcaagccttagtcacataggtcctccttctgattgtttaatataaaatgagagatgtaagttctccaaaaactctgcttgtatcttctatttttgagaaatgatttaagtgcatttaaaagcttagtctctgcttgcccagaatgcttgctcttcaaaatatctgctccctggagaggtaaactcaagttagtcttttcatgtgactctggatcgttgacctggaagacttcggggtaatggaatgggctttggcactgatcgctgttttctggttgagtacccagcctggaaaggaaggcgtgactgagccatgtgcaaagggggagggtgggtggagtctgacgatgtttgaagcatgagtacaccttcatttgatgcctcgatttactgagggagagaactctaaactgctgcatccatggatggatggaagtgcctcagcttgtaaggatgcttatttaaatgattttgcatattcaaatgattctacagccaatcaaacgcattcattccctgcctggtgagtgaaaactgaatgacacttgtgctccctctgaaaggaacagacgttttcattatcaaattcaaccaagcagaaaatctggcgaagggagcagaaatctccatttatttacatctaccatcgactgtttggtgataggagattagtaggttgaggaagagccttgttctcatttagctatgtgaccctagacttttgtctccttgaaaatacttacttaggttatgagcatgaagccaaccaaaagtctcaaattgtgcatatatatttaattctctatagatatttctggtgcttgtgggcagagagaagtcctagtcacatattaacattctatgtcttccttatactttaaagccattgcttatcagctgtaaaagcttaactgctgcctttatgttctgttagcagagtgtccccatctgacttccattttatttgcatcagccggtgtagttcatcataaaagtctgcattagagaagtggatcagaaccctccaggggaatttgctgccaaagcatagttagagatctaccttttgaatcctccatataattctttcttgcccaaacctttctccgtacaagtccaggaattcaattatttcagctctctgaggagcggtaagctccagaaaattgatttgcaataatgaaactaagccttgtttacaaatctgagtggcactttcgaagactggactggcatggtgacaggaggagggtacgaatatatctaggggctcaccccctttgaaaagatcatgtttgtggaaacacggctggaaaggatataggtaatttctaaaagaccttgatgggtcatgttttaatctgcttcctttttaattctattatctcctgtgttgctcatccctaggtgtgctgctgagagcgagtgctttaagagagtgagtgctgatagctgaccatagtgctctgatgcccagttaaaagctgagccagtttcaaggggtatggcctcatttctttgcagttgacttgttaagtgctgtgacatttttttcccattctcttctttctccccataagatatttgacccagtgagaaatgggccatttttctttgcgtacatgggatttgaaaagctggttggacaccatgacgtctctatgtgtctagccggtgactagaaatgccaaaagagaggtcagccttggaagagtagagaaagtgactgaatccttaggcccgagtggtattcctgagtgacagtggaaaatgagcagagggcagagctttgtgcaatcaggactgttaaaaagtgggtgggggggtggcactgagagtgagcttcacacagaaagcagagaacaagagcagtctggcttgggggaagcgggaagagaggactgaagctacaagaagacggtggtgtgatggagtggtcaaggaacacggggactgagaccaaagcatttggtgttgaccttgaacgaactcttgtcgatcgtcatgtgctgagccacgtggaaaggatcggaaagattccggcaaggtttagagaatgacggacggactagagctcgggcagaaactctctaagtgcctcttcctgtcttgattatagcctgcctcacacaggggtttctggatctggcacatggaagaccgggctgtgtactttttcttcccactgtgatgtcaggttttgctaatgactggtggttgtcgtgcctcactgtacctcagcctggttggcgttttgtaagtaattatgtgggtttttttttcttctctttcctttttttttaaagcaccgcatataactctaattaattacatcttttttttttaatctatgtggctttgaaaaaaatttttttaatgaggcagaaaaagaaaagcgtttggggaaagcggccagcgaggatatttgtgtttcaggagacaatgtaatataggacggtgtctctgcagggtccactttttagctcctaggaaacaagaatgagtttaaccaaaggaggctgaggcctggtgggaaccgacgtccttcggtttccatagcggagctagtcacatatcctataaatacaaaatataataacagcagaactgtcgaaagtggaggagggagaaaggcaggtatggtaagcactgattagggtggtaacaaagcgaatcctggaggcgcatctctcagcatctatgccgtttacgctcacacgatgaacagtatactcacatagtaaaaccgtgcagtatcagtggacagttgcattcagatccagactcctgttcctctactaacccctgtcttgggcttcacatgttctcccaaaacccctacctgtccgaatttagctcatgggtcctcaaaagaaattcccgatctttaaaatcctatggaaggtgtcttgtgctcactgccagccaccagccacaagtggccatacaatactgaagacagctactccagacagctttgcaggtataaaggcaaactgtggagcaaaggaaaatacagcatgctttaataagtatttgtgcaatggtttcacgttgaaaagacaaaatataggatgcataaataaaatatgttcccagagtgaatttagtatatattgagtatggaaaaatgcatactgctttttagaatgtgcctgaaaccacatatgtgagctactttttatttctgttgggcctgactgctcttggtgcacactgcttgcatatgcctcatttctcccatcttctacggatacagctccaggacaggttagcatttagtggtacccactgatgttgagtagccacttaaaattgcatcacatcatgttagatttcgatgtttattttcattactctttgaatttctctggccagtaagccttttttagagtgtctccactatgaaaaactgagcattcttatcataaaacctgaaattccaaaagcttcataattggggactttctagatgccacatcctgccataaatggaaaatcctatactgtaaaaacttgtttcttgtccaaactatgaaaggaattgcagagggtcagtgtggcctcatgtgtaagcccagcattctggaagtagagacaggaggggggagtattcaagatactgaaaaaacaaaaatgtggtaaaattgctggagaagtggccaattttaagaaccgggcagtagataaacaagaagaccctacagcatcttgtcagaatcataaagtctgtgcaggggggtatgcccgatgagtacaggagacaactcccaatagctaaaggtggaccaatttaggcacacaaacataatatgtacactgtatgtgaaatataacacatatactcacacacacactttcatttttaaagaaagtcattacacggagcccacgactgggatggagaatcacgccccacttttcctaggttagagtttatatgtgtaaagtatttagaattcttctgaataggagattgtcttttttttcccagtgtttcatcacttagactaatgaattttcctattatacgtcgatatttaattctgtcctgcacagtgtgtgtgtgtgtgtgtatgtgtgcacgcacaagcacacatgctcactttatataacccctataaaaactttgtgattccaacaagatgctgtagggttctcctttatcttctccacaaatctaagaatcaatcatttctccagagtcctgtttccttttgttggagaataatagaaagatccaatatctaggctttgtgtgctcattgctgctgaagtgcctgctttgttgctgatggaccgagcaagtccccttgctactcctcgatcttatagtatggattcctgtagatatttctgtagctctccgtgtctcaattagcatccctaggagctcaccctgttgatccctctatcacccactggactgttctacttcccgtgcttgtctgtaaactctcaccccactgtgagcatctgccttccacccaccttcctttgcctccaccatttaattcagaatgcactgatgacaacatcacaattacagtactttaaattgtgaaagctctttaaaaaatcctaaaattgttagccattgttgatcactatactttgaaaaaatatcattattatttcaaaacaattattgttaacagagaggtacaggtagtctgtttctcttgaacacccatctcaccgttagtgtgttcacgaacgtgagcacatgtgcgtgtggtatgtatgtgaggctgaactctcctcacctgaatgagtctgaaagacttaaaggaaacttttagtgctcacttcttggcttgcagcttgcttgaaccattcactcagcttctgccatctgctaaattgttctctgaagaaacccagctgccagctgttattgtaatagttacggtgacactcggggtgacagcacagccactttacagaaccgagtcatttactcatgtgttcctgagaacccagaggtgaccctcaccatgaagcaaaactctgcctcgtgccgagccagttgagaggcattttggtgaaatacacttctgaaaacattctctccacacaaatgcctccggttgtcagcgtgagccacttatagggcgtcagttcatctaacgtgctgaaacaatatatatatatatatatatatttaaataaaatttccaagtaaatatgagtaaacatttcttcggtttgtagctatcactttgatatgtacatatgcagtgtgaactaaagcgcacataaatctagagtgggtatttgtacgtttgcgaatttatggggacatgtgagacacatctgatcctgggcatctccatccggtgtgaagtggcttctagtttgcacggcaggagtaggcaggctttgtttctttcctcccggatcttttcagtttgacctccagtctaaactcttcatcctagtctgaggtggtgtcacttttcccatggataatgtcaacagcaccagcctagtcagctatgatgctaatgacaggcgaacatgcccatctccctgtgttcctcaaaagtgctgaccagatttgtagctgaacactgtgtagcctgccctcacccacccatgagctcatgcaaattgctcttctctgagaattcaccccctcctgtttttgtctggattcataggcatgcgtttgctagggacttctgtaccctgttgctctgtggctggaatgtcttctgtcaacgtaggatgtttttctcttcccttttctcgctttctccagcgcattctcaacctattcgctctcacgacccagtaaagttctccaccttgtctctcagattagtccctactccagttcctccactttttctccatcatatttctcaccagccaacagtttctttcttattatcatgttcctctagagtgctacttcattgcatctcttgttggtttcctggattctcagccctaggagaaatgtaaataacttgcaatgaagacttgtgttaggggtggactgaagttcttgggagaggtgtttgaagatacccagacttctcttaagaaccatcattgtgagacttggaggctcactgctctcatcctgggcctctgcctccctctgcctaccggagctgttatctagcatacgtgatgttcaaatgtacaacgcaccacttcatctgtgaggctccacagagctccacagaatagctataataaacgtggttctcttgcttgcagcttttcctttgaaatcattttattcaaaaacccattctgactctccaaaacagtcctagttctgagaaaaaaatttctcaattgtctcacactggttccttcttattttcccctgtggggcgaactggtgggggtcccctcatgtttctgatagtggatgtttatactcctaatactacctcattgctgggatcttttttctgtaaagtcacaatataataattagaagtgcatccctgcccttgaatgcacggtactgcagaatctacctttcacaggtttcatagccaccattccctctccttttctcaaacgttctcttgtgtaagggaaccttatacagtaagctcactggcaaatactttctgctcacttccattgcaactcaattcgagcagctaagacagtgggtaaaaatgcagcccgttggcgggggatcacttggagggagagtctccctccctggtaacaccgggaaactgcagagcaggaaaccgcccatccttgctccattccgccgggagcgtgaccatgaggttataggttcccatggacagtctatcttgtgactacagagcccggtgtcacacagtcgcactgtgttcaagtcactgttcgatgggttctaactgatgcagcagaatgcattcccggccagttcatttggatgactggacattttagtctcattcttttctaatggccagactgatcagatcataacattaaaatatttcacgggcttaggataaatcattttcttatatcaaagccaagggagattggccatgtaaaccatggtgacccgagtttcaatgagtcaaggtatctctggaaggccagagagcagggacacgtgaaatttcagctcagctctgctgcctgctggccctgtgagcgaaccactgacctgcacttcttcctgcccatctacaaaatgaggtaattcaggttagaggtctgttctccccgacaccagagccagcactgcacgcctgcaggggccctgttgatttccacatctttgttttcttgccaagacatcagccaagtgtgcattttatctactttaaaaaccctctctcctctgaaatttgcatatgtgctttaaatatgaaattctttttttctttcacataaaaacagtttgcatggctaccaaaaaacatgcccagtgtgtattggagaatttttctgtttagagtaaacgttgccttatttcccacaatatgtagacgcggtgagcacagcttctccttccgattctctgtttaatttgaacattggctgccttcatctgaattctgttaagaaatgctcgctcttgaagcatgagtccacataaacaggtttatttccaaacccaaagcacccatccttgtgtatggaaaccccaggttatacctatcatagactttttaaaaaaaaaaatcaataaattttgatttacatattactctcagtctatatcaaaacatccatctttcccgtaaaactaaactatgttctagcatagactttgttaaaaaattaatttttaacaaaattcaatcctctcaattcttaaagaatttttttgctatttatttccatctttaattgtattatgtggataattctcagtaggacaatctgtgcacgaatgcagatattcacagttgtcagaggtgtcgggtcgcaacggagcaggacatactggatgctagggactgaactcaacaacagtagccctcttaactcctgagccatctctccaggctctctctctctctctctctctctctctctctctctctctgggagagatttttataatttagccttctaaccttcttgatgagtggcattctaatatgctttcccaaccctcaggggacgataagaaaggctgtccactggtaaatttcactttaatgatagggcacagtgagcttccattttgccctttgtcctgaggccttttaaagtagctcgtgttaatcctttgctagagcaatttttcgttagctataggcaataccagcaacttacagttaagtaaaataatttgcaaattaaaaattccagtatccttttaaaatagaatgaacagttgttagactgtaagcatctctcagtgactggctcagcactgtcatcgagccctggacagacgaaaaccgatggatttgattttgtttcttggcaccagtttttctatttgtacccccaagaactcatttaggccatggaccagaacatcttatgttttcttttgatattctaaaaatggattcaatattaacagtcagcatttaataataggccagcatttaatctgtccaataattacttatgaaacaggaaaacatcacagatgcaaatatggctgaccatgttaactaaggagggtggctatattaagggttgtggtcacttttgtcttcctataccctattttcctgaaatacctcagtgaataggcatttcctggccgccaggattggttacctgacttcctcagacagcctgagtagttcacctgggaacggtccttcctcatagatggtatctgtttagctctggaactaggttacaacctcctgtggtccacactgccttaggcaggtttctttgcagaggtttctcactagggaagtggatttgtaggagatgacatcatggctctgtgtggagtaagatgcatgatgcagctgcagaagtgggaagttttgaagtgccctttgcccttcccttcctccagtacaagcatgcttgccagagctgtgtcaggggtagggatggaatagtctgatggccagcattaatccacagaatctagaatcacctgggagattggcctatgagcatgcctgtggttgattatcttattatgttaactaggatggaacaagtggcccactgtgggtggcaccattcccttgccgggatcctgtgctgcatgtgtggaacaggggagcagaggagcctgttgtattccacattctctgcttcctggtagtggatgtcacagctgtgtgagagactgtctttctttcccaccatgatggaccctatgtgcccttggatcctaagacagagtcagctctttctcccttaggtcatatttgtcagagagtttttatttttacagcagggaaaatcagatgataaatgaggtgctgtccatacattgtgaaacttatcttcatgacctactctacccatccacttagactaacctttagtgatatttctacctgaagacattcccctgtgcacccggtcagattcattcactgtattgacctaggacttgcttcattctggtatgaaaagaaatctcttcattcttcaacagacattcattgtctagtagatgcagactttgtgctgaagcagaggaatgccacaatggacaaaaccaagagcaactaatttcacagcttatgttatttttcactgtcaatcttttaccctcatgactatgtatgaacatgcatgaacatgtatgtatgtgtatacaggaagggtgatatgtaacattcctaaccctggagtaccagtcaggcttaggagcctttctcatgagatgtaagttcaaagaaaacaagattccataatttgaatgaattactctttccagagtgtttttatataaacacatatataatacacattgtgtatgtacagattggagcttaacatttaaaaatgctgcagtctctaacaatttgcaagcagtttaaatttacaaaatacagaaacagacattggtgttgacagtgctcaaattaaagctatctgtttttgtactgtaatccttaatgacaacgaatgtcagtggctacttgtgcagctgctatatggatgcagaaactgaaattaattcaaggagaaggcactgggaatatatagggaacatacagccatcaaggatgcatgcatagggaatgtatggacataaggtcttcatggtagcaaggcagtcggttgtttaaagaggctgacccaccatgctaaaggtagtgtagcctttgtggggtttttcgtgcattgaaagttctgggtaagttctctgacctccgtcgagcccgtgtgtgtccatggtgaaatcagctgtcatacgcgaatgatacaggtccactctcctctctttcagttggtgagtttgtgagcgacgcccttctcgtgcccgacaagtgcaagttcctacaccaggagcggatggatgtttgtgagacccatcttcactggcacaccgtcgccaaagaggtaccaatctgtgcccgctttcctgcagagcgatctccttgggggaggggggaatacaaagatgtttttagagggttgttgaaggcagtaagttcttggtggttttttgtttttgtttttgtttttcgagacagggcttctctgtatagccctggctgtcctggtactcactctgtagaccaggctggcctcgaactcagaaatccacctgcctctgcctcctgagtgctgggattaaaggcgagtgctaccatgcccggtggcagaaagttctttatggaagcaatgttcaagcattttaaaactgaatttactttttaaagtaattttatttttttggcaaggtcaccactgaacagaaagtctaatgagctaccctgaaccatgtctgtacacgtttgtgcttctctatccatgaacagccctcatggtcagcaatagctctcattagatacatctctgggctacatcttacagatgaacataaagctgtcatgtttaataggcatatgtaaccttacattgagcatctttctctatttattttctaccatcgctcttgtcccatgtggtttgcataatttaactagctactggtgaatgagctggtagaacaaggaagccacatgttcaaggccacctgaggccacagtcgttaaagtcataccctctcctgccaccttcctttccacggtgagcgcatctggggtagcacgcgcagccctttgctagcctctgctttgggctaagtcagtggaatattaaggacaatagaatgtagtgaatcgtcacccttagaaccgcactgtaccctccatataattataatgcttttctcctaagtagttatgtcaagatgggggagccagtgttctagaattagggtcctttatctagctcaggagttcactaccagcgtcagttttgtacccctgttccttcctaggaacatttttgcttgtctgacctgtagaggcactaccactggcaggtaacagtcaaagaccaacagctaaaaaccctcccaggaacagggtagactccacctggcgacgtttcttttccacattaatcccatggaggctgagctataatagccctctgagctatatccaaggccttgtttctaaagtgcttctgagatccaaagtagagtcttgctaaggggctcactttggtcttgatattgcactataattcaatcaggccatgaacttgccacagccttccaagtagccagaattatagactagatgcactaggcctggctcctcagcaaattaatttagtccaaaatatcaaatacgttggttgacgaattaaagggagaaaaagggtttaacttgacttttatatttcatgaaagagtgtgctctgattcactgtaaaaacaaaactttctttatctaaaaatgattttggaagtggaatagctgcctgagcttacagtagactacatcctttgaagcccagcttcccaaatgataacctcactttgcgcttcctctgagtttgcaaaggaagactcccttgctactacgaaacaacaaactggtgattcctgtggggttaaaatgcatctataatacttttactgtttccctaggcatgttgaattattaattttttttctctgtcacggggaaatagtttctcagtttttctcttcgtgccgatttctgcaaaattaacagatcccaggcaatcaaaaagatactgaaagagaaatcagggctgtggagggcagtttcttccttcctgggactgggactctgagatatgagccaagagacaccatttccagaataagatgcaactaactgcctataaaaaaaaattctatatctggggtagagaaaagaggggataggcaaatgtagacggagccttcaattcctgaaaagccatcacagcccaaaacgtaaatcatttcctgatatttgtccccgtgtttagctttctggaacctgctttcttttcatgtttactttgtaaacataatacattaaaaaatgtttttaggtatatttatttcattttatgtatatattgtatatattgcctgcatatatgtatatgcacaggtctgtggctggtgcccataggccagagtcaaaattgggtattagatccatggacctggcggtgggtacggttctaaaccatgggtcaggggtctgctacaagaacaacaaatgcctttaaccacttaggccatctctcaaccccacctaccaagaaaacaatataaagatagaataccaggcagcccttgctgaacaccgggttagaaacgagttcagacagcaagccgcccttaccttctggagtaggctccaaatctatctgtccatgctgattttcctggctgtgacggcggttcaattgttccagctgtggttgtgttcgattatctgcgcagtgactgcgtttgattgttccagctgtggcagtgttcgattgtctggtctgtggctgtgttctattgttccaactgtggcgtgttcgattgcccgggctgtggctgtgttcgattgtgtggaccatggctgctgtccgactcttctagctgtggttcgattgtccgggctgtggctgtgttcgattgtccgggctgtggctgtgttcgattgtctgggctgtggctgtagtccgactgtccttgctgcggttccattgtcctggctgcggctgcggtccgcttgcctctgtgcccacactgactcctccttccttttgtagacatgcagcgagaagagcactaacttgcacgactatggcatgctgctgccctgcggcatcgacaagttccgaggggtagagtttgtatgctgcccgttggccgaggaaagcgacagcgtggattctgcggatgcagaggaggatgactctgatgtctggtggggtggagcggacacagactacgctgatggcgggtaaggcggcttttgagatgggtctcagattggctgagccatctcgtctcttacagtttttgtattctctgagtgtgtctctctgtctcacagtggaaagagacctctcactccagttatatttgataataccagaaaaatctaaccctgaagggctgctctgattcttgtatgccacttactgttagtgttactgataaaccttcatgaagtcattggaccacgtttgaatgtcaggaatactgatcagactccactcagagctgctcctcagtaggtctaccaggaagctagtagatttgagctcagcactctggcatgccattttgtcctgccatttggaaatatttttttattagataatttctttatttacatttcaaatgttatctcctttcctggtttcccctccgaaaaccccctatcccttccaccctccccctgctcaccaacccacccactcccacttccctgtcctgtcattcctctacactggggcatagagccttcacaggaccaagggcctctctgcccattgatgtccaacaaggccatagtctgctacataggcagctggagccatgggtccctccatgtgtgctctttggttggtggtttagtccctggaagctctgggggtattggttagttcatattgttgttcctcctatggggctgcaaaccccttcagctctttgggtcctttctctagctccttcattggggaccttgtgctcagtccaatggttggctgagagcatccacctctgtatttgtcaggcactggcagagcctgtcacgagacagccccatcagactcctgttagcaagcacttcttgatatccacaatagtgtctgggtttagtgactggcctctctccctatctattcaataccgtacttaaaaatacttttaaacactctttcgtgaactcaatacaaatttttggttaaggaagacatggtttgtgtttgtatatttactcttaaggatttccttcttctttgcttttggtttggttttggatgggtgggtagacccctcccctcaaccatctttttcctttgtgtagtgagcaacactaataaatgtttgcggaagttctttaactatctccagttgcgtgattgctggttgacattttttttttgcctcattttccttgggatcttaaccccttcgttaattttctgactcttttcacttgtgcacaaatatccatattcaaatcataagtctatgaagccagaatttttgagttagacctatgacccggtttgttgatgaatccaggctatcctatccctgaaatgtaaggctcgggctttcctgccaaggtcctctcagctgttcctcagggttttctagctcaaacggaacaccaaccaaaaatcacaaaacttactatcagtaagatgaggcttcattttagtactagctgcctgagtttatcaggacgtgtgtgtgtgtgtgtgtgcgcgcgcgtgtgttacagtcttttatatcccctctttaccatttactttcatccatctatctatttgagtcaggatagaggctacatagagaggatacatacaggatagaggctgcatgtagccctggctggccaggactagctatgtagaataggctggcccagaactaagagctctagctgccactgccttctgggtgttggaattaaaggcttgcactacttactacatccaggtaattgtcttgctcccccacctctcaaaataattacatttgatctagcttgacatagagccaaggaaactgaaaaaaagattttcagatacttctcggtgatgtaaaagttcaccacctatgcataagtctcgtgtttcccaggcaagaagtctccgggaagcagaatttgcttctgagatttctgtcatctaatgagttaggggttccccataatggcttgacaacccaccccctatacttctgttctatgtaccacatgtgggacaggaatgggttaaacttaattatctctctctctttttagaaacgaggtggcctagttctcccttattaagcccactcctaccctccttggccacatctagatttgaacgtttcagaggcttcggaaacaaatcccatccttaggcgtctgatcacagaaccagtacaaccagcattcctaaaggaaaatctagttacttagcctggacgttgtctgttttcataagctactggatatttgatttgctaatttccagtgagtaacctgactatggattgagaaagtatgcagaatggtatttaaacttgaaaacttccatggctggtgttaaaactctaaggcactagatatgtatttgtaaccatcttgttaaccatcaaccttgtgctgtcacagggaacatgtgtatgtgtgtgtgtgtgtgtgtgtgtgtgtgtgtgtgtgtttgtgtgtagagtttagagttcaacactgagtgtttttctcaactatcctccacctaattttttttatacttagacaccgaggctcaaactcaggctgtcaagcatttaatcaaacccctacctcccagccccagcagggactttttaaattttaaaatgattatttttattttcttgaaagccaccagcctctgccaagcttcttccacatgtaagacatgttctatgcctcgtaaaaccttctttttaagatgggtccagttttcctcaggttttgatcttttcatcctacactttttttctgagatactgacaccattgccacggtatcagtggccctttctcctgctgctggaaactgatcccggcagatggctttgcattctgacccaggtctctagtctattcaccacgtcactgggtaattgtaccttcttgatacccatctctgagtctatgacttcttttagttctcactgttacaactcccaagctaggagacatttgttttcctcctttgaatgtgctgtgtttgaatgtgctatgctacctcctagagaaggggtatagtatgttatctaaaccagagagaacactcagaccccagccaccccctgcgtgggtaatatggtcaccctgtcatcatcatcaacttgaaatgcaagctggctcctctcctaattatcttcctttgtattctgtctcatgttccaactccctcatcccttggagacggtgcacgcttagtattcccaaccattacatctgaaccactcaccgggtcttgctgcctttcagactcatcatcacagcagcagcatgcaacccgtcgacctttcctttcttttgcccatgatcaatccggacagactgaaccactcacatataccccacacatcctagacttgcagagatgttcacatttcccaaatatattttggtcagttctcaatgccggggaaaacttaacttcttcctgtaaccacttccgaatttcctgagctatcgagttgtgtaactgagccggttgattccacgtcgtaacagcagctgaaaccttaatgtttctggatgctcctgattactgtccccatttgaggacagatcatcgtctaccaagccatcaatccaaaccaactgccttggtccctagcatcacctttcttccttgctgtatctatgaccctttcatagctaacctctgtggatgtctagagcaaggtacctggcatttggtggacactcatgtgcaagtctcctttgctacctaaatatctcctgtcccttattcttctagcctggattcctggttaccccccaccccccaactccctccattaccctttccatctcactggctccacctcctttacctctaaacctgctctttctggaatgatcattctctggtactcccttccttattttgggagcacaccaatgaaagtggtgatctcgtactgtcccatccttctcggcaggcccatcactgctccatttttaggtttctggggtttatttggaatagttagcgaatgacggtgacatacttcttgggatgtcaaaataagaaaatgtcgtaacctaggaaaactgaggtcaggaccctgcatgtgtcctggatgtacgatacgttacggtggacttgtatgataactgtacaataaaatgagtttttcttaatttttattatttttctccgagaaagagttaaagttcagaaatactattccttcttagagttacttagactgctcagaaaggtagccagtgctgggattccaagagttaacagcccatcagttcctgagagtttgtcacttggcaagtggaaacacctggcataattgtgtaaacattaggtgctcaacaaatatttgagtagaattggagtggccctgacatcaaatccgtacagaggcgcagtcattgtcaccaaaggtcagcacatatacacaaagtgattggtgtaaagaaaaaggaaaacccaaacaaacagcagaggaacatcattcttggtaggcaatgattacatgaaattgcatcagaaatccctgaagctagaaattgtattgaaaaatgtactgagaccaaaggaaaattaatcctttcttaatgacctttaatgtggagcctacacgaatacctcattcaaaaaagtgtgataaagttagaaataaagacaagattacttttcttagaccctagggtaaaagtcagtttgtgtttgtgtttggtttggtttgtgtgtttggcaggaccaaccattgtacctaaagctagggcgggggtgctttaccaccgacgttcagcatttgcccttttgttactatttgtttttaatttccgctggcgacagactctccctctgcagtacagggagccttcggctttctgtacacttgcatcagcttccggattagccaggattattggggctgtgcaaccacactggctcctgaagtccattcttagacaaacttcttcctttggaatcagtaagtcccttttgtttctgtcaacttggagtgcttaaaaaaaaatcaaacaaacaaacaaaacctgtaggtaaaatcccagtaaatacaagttatatgcatgggactaccagctgttggcaagcattctgtgatttgagaaacaaacttcagtgaagagcagtatttcccaatggggaacgattttcactcaaggggcatctggaaatgtctgccggcagtttgagttgtcacagtgtgggtagtgtgagagaaatgtcattgtcatcaagggggctagggatgatgacactgccaaacatcccacagtgtataggacatccctatgacattgtggagtgtgctggggttcaggacccccaatttggaggcaagaaagatgctccaaggccaagagtacatgttgctcttgcagaggacttgggtttggttccgagcatccgcatggcagggcacaggcatctgtaactctagttccagggcctctgccatcctcatttagcttccatgggcactacatgcatacgctgtgcacacatacatgcaggcaaaacattgtacacatagaaaaatatatatcaatctaaattaaaaccagtttttttttccccaagtgtcagggttcatacctatagacccagcgcttgggagacaaacacaggagttttctgggagttcaaggttacctgggccacagagcttgttctaggccagccaagactgcataataagactccatccaacaaaacaaaacaaaacaaaacaaaacaaaacaaaacaaaacaaaacagggggggaaaaaacctctatttgaaggtttgtttaccatttaagttttagggaacctactctccattcaaggctctgcctctaattctgcatggacaaagaagcaaccatctacccaccttggagagtcttcctctaaagtacagttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctccctccctccctccttccttccttccctccttccctccctccctcccttccgtccatccatctaaataaaccttcctagcctcagctgcagccttaaaattctgtcatcaaaatgtgcttaagtgcagggaacttttattgagacttctcatttgtaccaaattattttatgaatctatgatctcagttttgctactgtaaactaccattatactttgggagggggtgttgtagcttaagatattcagtgaattttaaaagcatgagagagggaggaaaaaaaaagcatgagagaatcttaatgaccattgcattccatttgaatttttttaaagctgtcagatgaggggcaaattattatggtttgatctgattgtaagttttatcaatttggtccatatagatttacttatagctaaaacaaaaactttaatcctaaagtattaccatcatgtactttgcattcaaagtcttactgtttactccttgagttctgtttattatggttcatcgtctgtttttatcccactgtgagatgttacacaggtggtcaatgcagagcacagacttccatgaactcttccttaatcaccccttgtaggcaggataggaagttcacattaaggacttgtttgtaaagcagcactctgctaggtatagtgactgaaaaatcactgtcattatggcctctgtaccccaagatcctctcagacattaatagccacatgactttatagagtaagttttatttgaccatctatcttctcctttatatctgtggagtccaagttcttagaatagtcttgttcagtttctgccttgggctttaagaaaaggctactcaaggctgacgggagaagaaaacaccacggatgttagacggacaccaagtgaatcacacaaatgatgaacgaaggcctggggtctttgtcagtggatgagtcgagtctgaatggaaccgatgaagcagcgcatggctttgcgatgtgactgtcacagtgctggcttggcagcttccagagctgggctgggctgtctgcctctggtctgaataaaggaactaacttgacaatgatgacgaggagaattgcagagacttgtacttgcccttgaggacactggccgccactaccaaggccttattagaaatgctgtctctatagttaataaacttggatcgcatatacattcagaaaaaaaaaacaaatcacgttaatagtctttaccggattccagacgatgtgaggccaagccagtggggtttgtttcggtttctgagcaggagatggcagagagaagagcgtttttcctgtataggacttggctgctggtatctgaggtacagttggtactgcattgagcacaaggtgcccactaatagaaagtcatctgatgacataacccacactcttggaagtgttattttaagggctgggttattcagtgatggtgatttcaggaccgtggtccacggtcagagagtaagacaagagaagaagatgcagattcttgttgtttggactggatacagtgactcgcacccacaagagctaatttcctgatgaagctgggatcaagataatgtcatctctagagtaaaatcccttgtttgtatggaatttatcaccgtctcatgtcaaagtcatgacatttaaaatctttaatttacgtattaagttgttatggcaaaagatatttctcttactagaactacacggcatgaagcggtgccaatcgctttctgtaagaaactcagcaaaatgtgaaagcatgtagttcggtagaaggaagtcagtctttaggcaagtgtgaaaccacatcctctcacttcccatatttatgaactaacattttaagggaaccggtgaaattaattgtgaaactagagatggtgggcatgcccaattttgttgaagccaggacatgagtgtgtccaagtagatgaggaaaggggagccctgttagcaaataagatcgtctggctttgcaatcgatgacccttagacagagagactcacacggggcgaatcacagagaagagaccgtagtgttcagccataaatgacatctgtgccatgctcccatggctcagggatcatcacagaacgtataagagccaaaggttgcagagcactacttcaagaaagggttcctttggacatcataggcttcgctgcccatgtgatcccatagcagctgtgactacatgcagaagacctgtgtaagatcaagccagtcagaactctaatgtagggactggaaggactcaggaagccccactcctagttgaacagctattgacaatggataacttcactgagagggtgtgtcagttttcttcaggggtgcaggccagggtaggttgcccatgcaccagtggctggccctatgcttaggcacataccagcagcaccgcaccagctagactgcctggttaatatgttaataaatagcaagcacatgaagttgtgaggtagctttggaaggaagagacataagagggggcagagaggtaagatggtctgaatttcatcaagacattataaacatggatgaaaatctcaaagaataatttaaaatatacatttttttttaaaacatgctttaaccctagcatatctgtttgcgcctctttcctctgacaggggtaatgttagataacttgtatcacagtgctttttggtctactgactaatgtacggacacatttataacgtgtagactggatcccgaagggaggtaaacccctatggagctgatctgtagaccaccccaccccaaccctgtctcgttctgccaaattataaaagcactcttcggggtgtggagcccagtgtcctacatctgctcaataatcatgaccagtatactgtgttcttctctcagtcgactcttaaggctttgtcactgttgtaactgatactgagagatgagcacatctcagacctcttgtcttagatgaggctgagaacatcttaaagcagctgttggtagcaagcgagtgatgatactccttttttatatgcctgttttatctcttaaatatccaagaattattttaaagatgcaaaaaaaggaccaaaatataagattccctatgactggaaattgcccattaaattagttgtggttgactttggttctcttggatatttttaaatagaaacttaatgactgtttaaactttcaatttccacatctgaaaaccttccattttatattctcagttatatatttccgaaatagagaagaattgcaagtaagagcagattaagtttttaatcttctgccccctggaatatgctgttcatcggcttcccattgtagaaccgttgattgtcatgttaatcggccttcagcagaattttatagccagtgttgttagagctggagctgagttgtacaagtatcagatgtagtaatgaaagactttggctttatgaaaatgtgtgtccagggtattcctgggacagcggcacctcatttaattgaggagtatgcaggtcctaagtccattgacacagcattgccaggcacctatcccacaaggctccagacccatccactactcatgcaatactcatgcaatactcatgctgacactcccttagcaacgcaggacgtagagcatctgaaaccgggaggccttctaagtcccttcagcttgacagtattgtttctacccatgcaaattgggaattgaccatataaccattttagatacacatttatgacatccatagtctctgatttaaccccctacattgaatgttttttttttctctgtcatcaacacaagtgacaggcttttccttggattccctggattttaaccgtcaggtaccagtacatgcacacacaggcccaggcatctgtgggcacaggagttcgagcaaccatagcagaccacggaaagcttagaaggtccttggaatcctttatttcctctccatatctgacttacctatcctactattaccagcctgttcttcttgtgtgctcttcagtcaaggcattgattgggtcttttgtttattggattataactacctgctctctctttttgtctttgattgtaaatattagttaaggcaaatagttcaagacttacttctgtagcctggaagacctcgttattttacagataaatgaattccagtgcatacgggtgttgttattggctgctggcccccagccccagttgggttccgtgatatctgttctatctttagaaacactccttgaagtattagagcccagggctctgcactgttacttctgcaaattctgccaggtttgcttcacctaatctgtttatcctgtccaaatacaatcttagtctaaagtaccttaaaagacaaccaaaattagtaccctcctaaagtcttatcattaactttctcctatgcattcatacttcttcaacatacagattgaaagcttatagcctctatagagcagctacagtgtggaacacgtgaatacataaccctgatgtagaactccccaacatgctttggtgagttcccaacatactaaagagccaatatgcagggtgaatgcagggaagtcttgcttgaagcaatgtaagtggatacagttacagagattgtttttgtgccaagccctcatgtaatctatgattctgtgtgtgtgtgttcctgttgtatatatgcaggtgaatgtatgtgtgcatatgtatgtggaaaccagagaacaaatttggctattgttcctcaagtgctgtcaaccttgtttttagagacaggctaccactggcgtagagctcatcgaataagctgagctggccagtctgtgagccccagagatcatttgatcctaacctccccactctgagattataaatgtggagcaccattcccagccatacatatatatgtatgtaaacattacatacatatgctgggatttgaggagggaaatccttcccttgagagggaaacaccttctgggtgtcagccctctatttcctccccaaccccccacttccccacacatatcaagtctctgcaggactaggcacagcctttcccactgaggccaggtaaggctgtccatttagggatgcaggatctataggcaggcaagcagacaacaggctcaggaacagcctctgccccagttgtttaggggtcccacatgaataccaagctgctcatctgctacatatgtatgggggagagaagggggctaggtccagcctgtgctcatgctttagttggtcaatctctgggagctctcaaggatccaggttagttgactgttggtcttcctgtggagtctctgtcctctgtggctctcccaacatttctcccaactcttccataagactcctcaagctccatctcatgtttggatgtgagtttctgcatctcttcccattggctgctgggtggagcctgttagagaaagttatgctaggctcctgtctgcaagcataatgtcagttagttagtaatgtcagggattggttcttgcccctgggatgggactcaagttgaggcagtttggttacctattcccgcagtctctgttacctttgtccctgcacatcctgtaggcaggacatattttgggtcaaaggctttgtgggtgagttgctgcccctatccctccactggggatagttgcctagttacaggaagtagcaatatcagaatccattcacagctagagttgcccccttagaccctctgaggcttctcccatcgtaggtctctggcacttcctagagatcgcccctgccctcagctgatctctgttccctctcccttcttctccctacatatgacctagccccactcccctcccacaggaacagacaagtctccctgcctgtagtcctcttcccctgacaggctcatggccagtttggtgttttgttttgttttgttttgttttgttttgttttgttttgttttgttttgttttgttttgtttttgtcttggatatcagctccttgtttcacagaaatgaaaggagtcacccttttcagaagatccaggcttcactatttcagtcttggcatcccgtctgtgtgtcctgacactgaccccgcgcttcagcattttatttgctccttgtctttttctcctccagtggaatgcgcaccatgaggaggggcaacttactctccttgtccctttgggaacctcatatctgactcaagttctagcgcacgttatccaccggctaacgttatccatcttcttgtgtccattgtctgtggttttggcttccacgatctaaaaatattagttggaagtatctaaaaataagattcgtaaacttttcagttgcgtgctgctttgagtagcatggtgacatttggcgccatctgctcccttctgctcaggacatgagccaccctttcccaacagatccacactgtgtatgggtcttgcctgttaatagttgtctcagttctgcaaccgaaagttgtggtattataatgcttatggatttttaaaagcatttgtttaataatggttgtaaagggcaaagatgatgctgacagcttttatatttgtttgtttattgtcaagagaagccataaaatatcatcttacaccgtcacataaggtactgttcaataacatactgtggaaaagagaccagattcatacaatgtctattatgggacattgttctaattgctttttgtagttattagtttcttactatgtctggtttataaaagtaaattttatgagacatagatgtgcgcaagggataaaatctataatatgtatggagttcagtgctctctacagttccaggagccctctggggggccttgggatgtctcctcacacataatgctgtttaaaacattgttcccaattaataaaatgggatatttactgttgaataaaacctataaggcatctcaaaatctttctcatagatctctgaattgacagcagtcgtgaaatacgttcctgggttgatcagggacagaaacaagagctgtacaattagacttcagaaggccagtctctgtttctactccaggtgataatgtaaatggtccatgttagccatgcacaaagtgaggggccatctgctccactatcagtggtctttcaggaattgtacctcttcatttttttttcaatgctgtgtatttaagagtcataagaaggccaattcaaacagactgtattcgtggcccaaatttctggcccttcatttctagctgtctgttgatgatccttttccaatagtatctgtcagcatgtcaaatccatcatgatcaaagccggatccattaacgtctgctccttgccactgggccttcctgctgtatcccgttgccattagtaaccatccctaccctttctccatcttgaagcacaagattcatcttcccactaaccccgccccatccagacggccaccagttctgttattctctgaaacccctcatggtttctcagcctccttggctgtgcttctcctgaaccttctccacacagcccctgtcactctgtcacctgtctgacccccatgccgcttccagcgcacgaatgtcgatgtgtgaccgctcttccatcctttgacttaaagtttgtttattacacgctgggttcctgtgcataaggatccagatgagtcttcagccggtgaaaacaaactctttcatagtacagccatggcctgccttctgttttctgtgaacactcactcgtgttctgcagcctacagagctcttggccctctgttgtcccctttcccatgtgctctttcctgtagcttcgtactcatatattgcttcccactttattatattttgattctgttcttaagtctgccttctccagatcttgtctctctctctatatatatgcaaatatatttataaattgttatatattgcttatatactttatatatgtattgttttatatattgtttttatatgtttatatttattatttatatatagaaacaaaaatgtttgatttatatagtaaactgataataaatagggtgaacaataactagtagtaaaacagggccattatatcaggttgtggcaataaaagctagtcaaaatgcatgaattgtttctctcagaaacttttcacaaaatattttaagtccgaggccgacccgaaggagagtaactgaagccacatctaatgaggtgacttactgtgtacttagtgtcatctgtcttcctgatagaacaaagcactcacagaagcagctgttgtcagggacttcacctaaaacacaagatgtggccacactgagcgcactacatgtgactctccatctacccttgctgcactgtgtaaggaacactggtgtcctgtgtgctgactctgagttttccagatacttcttgagaaaattcttatcaaggcaagaaactggccttgctggtaaaggaaaaaaaaaattacccacagtggaaaagcccttttcctatctaaacacgcattcctcagttttctggctaccgagtcctttcatgatgcagtagtgataggcttaaatttatatcacctctagtttatatccaattgaaaagactcccttactcacttcaaaccctcagaaacaaaaagaagtggggtatgtgaggatccctggtgtagcttcctttcttgctattttttccgggatgagacaacaagacatgtctggtctttccggaaaggctctcctgagagcataggtgcaaccagcatcccaggggttctgccctttcttagaagaagggttgcaggttcctatggctacgtcacgtatgaaaccaatgtggctttcatacaagcaggaagcttccctttctccttctcctttccgaggtcgtgtgtgtgtgtgtgtgtgtgtgtgtgtgtgtgtttgtgtgtgtgtgtgtgagagagagagaagagagagtgtgtgagagagagagagagagagagagagagagagagagaggcttgattagtttctcactttaagacagtcctagaaagctggataagcatttagctcacagatcacctgcagttttatacttgttaaaagaaagcagaagagaagactgggcacagtgtccctcagatgcttgtgttcatggtgtcttctccagctgccttcattcaatacttttctcacggctgggagcaaacaccaggacaggctataacctaaagcttcccgtgaaagacccacttctttttttttttattagatattttcttcacttacatttcaaatgccatcctgaaagtcccctataccctcccccaccctgctcccctacccaccctctcccacttcttggccctggctttcccctgtactggggcatataaagtttgcaagaccaaggggtctctcttcccaatgatggctggctaggccatcttctgatacatatgcagctagagatacgagctctgggggtactggttagttcatattgttccacctatagggttgcaaatcccttcagctccttgggtactttctctagctcctccattgggaaccctgtgatccatcctataggtgactgtgagcatccacttctgtatttgccaggcactggcatagtctcataagagacagctataccagggtcctttcagcaaaatcttgctggcatatgcaatagtgtctgggtttggtggctgattatgggatggacccccaggtggggcagtctctagatggtccatcctttcatcttagctccaaactttgtctgtacaactccttccatgggtattttgttccctattctagggaggaataaagtatccatgcgttggtcttccttcttgattttcttgtgtttttggaaattgtatcttggatattctaggtttctgggctaatatccacttatcattgagtgcatatcaagtgacttcttttatgattgtgttaccttactcaggatgatatcctccggatacatccatttgcctaacaatttcataaatttattgtttttaatagctgagtagtactccattatgtaaatgtaccacattttctgtatccattcctctgttgagggacatctgggttctttccagcttctggctattataaacaaggctgctatgaacatagtggagcatgtgttcttcttactggttggaatatcttctgggtatatgcccaggagaggtattgctggatcttctggtagtactatgtccagttttctgaggaaccaccagactgatttccagagtggttgtacaagcttgcaatcccaccagcaatggaggagtgttcctctttctccacatcctagacagcatctgctgtcacctgaattttttatcctagccattctgactggtgtgaggtggaatcttaaggcttctcggcctcctgaaacagtgctaccacctaggaaccaagggttccatacacgagtgtttgggaaatgcctctcacgcaggccatagcacagctttggacagtccaaatgctcatcccttagtcatccctgcctgtcctagatagtgttcctgagttcagttccccttttgtgctcatcaccttggactgtgccagtagaccaccatttcttcagttcgtagtcttttttggtctataggatgtgcgtaccaggagggcagagacattctctgatttgtttctcgcaatgtcccccagattttgaacatgcccccaaacttagtatgaagcctattgtccaaatggatagagatcatggattccctgatctccatttgcaatctgcacacggtcggtcacccatactcaccaagaccctgatcttcaggaatttgttccttcagaggtttctggcatagcctctgatgaaccaggattttgttttctcacatcaagaatttagaatggttctaggacttttttttctttctcactgcaggtgcttctacttaatcctgcacggatcataaagctgtcaggacaatgtactttatattatatatcacttttcttacttccaagatagccttggggggaagaaaagcactttagtcttttactgtaattatagtccagatttagaagccttgccagaatatcattctaccacacttttttatgatgctgaaatattttaaagaaaagttcagttaagagcatactaactaaatatgtctgtacatctctaaaactgctgctctgcagaacacactgataccctctcacccacaaaattaataaaaaaagaaaaattgataccaggaagtactaagttcacagatttgtctaaactgtttttcatggtttattttttatataacagatccttcctaacaacagaggttttttttttcaaaaatattttatggttggggtgtttttggtttttgtattttacctgcatgtatatctgtacaccacatagacctacccgacaccccatgcagtgtccaacctttgaacttccagtccttcctgcctgttgtccactccattagcaagatcaaacaagtaaaaaacgtctctgggtatgtgaagtattaatatgctaatgagcaggtaggatgtgtgttctggagaccatgagagaatttcaagtgcagtgtccatgagtgaccctgagcaagtcagaagatgccataactactgaatggcaaagagtatagtctaatggaggcattcaaggttggatgaatggctgcattgcctatttattcattaatttacattgaacctgcctagatctcatttacatccacatttaaccactaaggaaaaagccctggtttccttctgtctttcctctccattaaaactcagtgtccctgtgaacttttgttgggatcatcgttatttgcatattgttcccaattgcataatgaatgcatattcctgactcatcccaactgcccagtggcctctggcctgtgccagtcactttctccttggaatttctgaagcgagtgttatgcaagtcccctgttgctcactgagccattagtagagactctctcacccagaataggcattactaaatgtgtgatgacgactcagtccaatttcaaaccaaggttgggaccggcagctcactcttaattgcctgagtcatgcagttttgatgtctcagtctttaagttaaggctccagctgggtttgagatccttcctcagcaaggaatactttagctgcaaatgtcaaaaatcgccaggattggttcagagtctttccagtgagctgtgcttaactgatggtccactttgataaatctaatgccatccgctcgtagctggcaggggcttctgcctttcgggtggtcacagaagctaggagtaacaaggcaaagaaacaaagacacaggggctaccttttcatctggatgtgacttctccatgaagtacaggcatgtagcctggcttctggttgtttagaaattgccggttgcaaggccttctagctgcaagggatgcagcaatgtggactaatgggctatttggttcttatccatctcctgtcaagggaggggaggaaggacttgagaatgaccttgggtaacttacacagtatctgctacaaggagtttatgctttcttcccaagggaaacatacatcggattttgttttggaaaacttctaactgaaaatttgatatgccttgctagctagcatgtgtcaccaaggcaactactcccctatctgcaggagatacggcctatagggttctgtcatcactacattgtgtatatactttttgttgctttccttctgtagagtgtgcactcatccacagaaagaggtcattgacagattatcaacagatcatgaaaaagatggagtgatcataacgatagtgtactaagaattacttaaaggttatgaattgtttctggattttccactagatagttttttagacggtgtttgaccaggtaattcagagtgtcatcacagtattgtagaataaaataggaactacattttaagtctatagcatcaaaagaagactttttgtgtatgtagatctgaattaatgaagcaatcagtgtagaggataatttgcctcgttcaacatggttcagtgatgccatgacaaaaggtactatagatatgaaaaatcatagccgtgtttttgctttcttttgttatatttacctttattgtatttggaataggattcttggaagagggaatatgtttgcaaattgcaggccctcaaaatggcagttttgctactgagagtttttatgccagatcaacccacaagtatttataagaagaaaagtggtttgttacattaggaaaatctacttcaagtcttttttttttttctgaaaaaggggtgtgcattaacaaagaactcataacacaactctacagctttgcctaatttttaaaaccaaaaatgacctgatagtctaaatcagaacacctacccttaccagccaccctctcctgcagtccaggtttcttctcaccagatcctacaactcctgaattcatctgcttgaacatttgcctatattcactgtttctataagtgagtgggacaaggttcatgtcagtaaggacagcatttaggaggccaaggcaaaaggttcctaatgatatcaaggtcatcttaggctgcttaccggaaccttctctcaaaccagtataaacaaatgagtaaagaaataggctaagagtgaccttgtgtgtttacttttggaatgggagtgttcttgacttcaccttccttgggctgtcctttgtggacgatttcctggggaccacagaaaacaagcttaccttcttccgtgtttcttcatgttctttgcaagtaacaacaatgatctcagacattgcttttctttggaacacactgacttactcagttggagaactctgaatccaacgaaggggaaaacatctgttcatctcaggttgttttcttgtgttattggtgcattggcgtttgtttgtttgtttgtttgtttgtttgtttctgtcttcatggctgtattttctctgtgtctctcactttgattctgggaatctctcacagacgcttctgtcttcctcttcttcccgtacatcggcatgcataggtctgagccccatcttttttcagtcatgctcctctggcctcttattggtcacaacatgttgggaactggcttttggttatttttatcactgctgaagtggaggccagatagtagatcgcattctcgtacccatgaatatcagaacatctctctgccatttcttttctccggtttctatgatagcaggaagaaagaaaaacaaactaaatgtttacaggctgtgaaacaacaaataaaacttctaaaggtcctttattcatttaattgggcaggaggtaccaacacattcaattatcccttacttcgtgacttcaaacccctaccattgtgcccaacagaggaatacatgtggcccccactatcctatcatgcagaatagcttcacagaccaaaggaccctcaatgagctgtgagttcactcctccctgagcctccaccccacagccactgatctttttactccagcctttggccgtacatggaatgtcagagaatgcaaatggcaaaacactttgcttgactttcaaaacaaggaatgaaagctggtgtgtgaatcctgctgcctaaggagactcccaggtggcagcatcatatgcaattatatcaggtttagcctcgtgggaaatggcgatccaccttcatggtagcctttatcctccagcaaagtacaacctttcactgtgtcactggtgactcactgcacctcctcactgcactcagatactcttaggatggccaggagctcctgtttccttagtatttcttagtatttctcactttaaaacctagagaaagcattggtaatatgtaagctgacggcctttgcagttgggggatgggatgagagtgttctgccatcttatcatctttctgtgactgtttcttgcccggcttgtgaagaaatggctctgcctcacattttcacagacttctccccgcccttctgttttctgttgctgtgctcagctttacacacccatctcacctttcttacatcacagaagaaactaactggcctttcagctggtggcagaaaaacatctttcccgcctgctaatgcttcctgttagccctaaaagctccaattagaagtcataagagggacacgttcaggattctcggagaagatgcagcctcattaaaacacaattgtgtgcttctgctttaaatagtgtccaaatagataagtgaattcaggtccgcctaaatttaattccagaaatcaaagccacggcaataagaactggacctgagttctcttagggcaagtaatttaatttctcagccagttgaactattatgcatctcagttcttagttattatgacagtaaattatgccgacagaggcggtgaggggtgatgtgcatataatttcttctttttcctggctaagcacacaccagaatgcagatgtcttaaacagcttttccctcagccaaggcttccgtttggagctttaaaagcagtgtttacgtaataacggaagatggatagacacctcagggaatccagctgtgtatatgcttcaccctacctgacagcccagggctaaccaaatcctggactgtataccagtgatgaacactgtcacaatagtcatggaatgagatcatgggtaattcatggtttatagagaatcctggcctggacttagcttttctccctgccattgcttttgcattaccactgacagtggagaaacaaagggaattgtgactgattcgattggacaaagaggggattccagacacaatcaattcaggaatctaccacccttcactagaaaaacagccttgagattaagtaaaagactgtaccccaagtcaaatctgcgccagctgtaggtttagtttggaaatacgccatcggtggtagatgtgtgcacagagagttttgtgcaggcaatcaagaaatcaattagtttaccctatttatatctaggcagatggaggcttatcctatctgattatccatttctcacctatttcttcatggtcttgatgagaatgtgaaaatcagttatagtctcctacctatcaacacattatgcattagcacttcactaaattattcatcttaataatttcttctgtacattttagtcaaacgtttcagaatatgttgtgtttttcatcgtatttcaccagagttggggaaatgtccccttgaagagcccaacatagttttataggattttttcaagtcctgcatcctgggcttgcacccaagggcctgctatgcatcattcattacagaacctgtacaaagtatccctggagttggaggaaaccacaccggtcccttggtgctacatccatctccttggatttcctttccctttcattttcaggacagcatctcactgctacgctgtcagacactgactgtgagagtctttcaacctctggaagcatgtgagatcacagctgggaccattccagtctctagctcacatgatacagtctatgacactggacgcacactcctttagagctgagctgtgtccttcctcaacacatccagagcatcatggtgtcacagctcatacaacctccagatttccattgcctttcccaatggaaaagcacactccttcttgctggccacactccacttcggggtgatagtttccgtgtgccctgtttgttggtggggacactgacctggccatggcctcttttccactctcttgtgtagtgcttctcatttgacacaactgggccagagagtctcagtctcagctgtttgtcttgtgttggctttttgatgtggtccagcatgtctctgtcctttcccagtaggcaatacagggtaggctctccctgcttttatcttcatccgtgtgctcttggccaagctggcattggcagccagttgctttccgcacaggttccttagtagttccttaaattgtgtcctagacatgtcctttcacgattttatcttgccaattgctacctgacctgtgtgtgttggtacatagatgtttacagccatattatctctcaacagtctacataattttgccttgaccgaagcgtcatataattggagtcagagtatcttctttctgcaaccattaaacgaagagctatgtccacttgtgaaacattttgtggacctcagatagagttcctacttaacagcattttgaccttcctagtgttttttcatcaatcccatactccctcacgcattaccaaagtcccttgattctttttcttcttcactttcctaaactttcattcagccgagtctctcacagctatttttttatctgttcttccagtgaagacaaagtagtagaagtcgccgaagaggaggaagtggctgatgttgaggaagaggaagctgatgatgatgaggatgtggaggatggggacgaggtggaggaggaggccgaggagccctacgaagaggccaccgagagaacaaccagcactgccaccaccaccacaaccaccactgagtccgtggaggaggtggtccgaggtaagccgctgttggattgctatttaactgccctgggataagagatttcaatcagtgcttcccttctccagccccctgccctcacctccctcccaccactcccccaaaatcacaaggcttcttcctcttggtttattgctggtgttggtttggttgctataacaagccgtccagcagtccatttaaactaaaacaaatctcgcttgcatagtcacttctatgccttgtgtatgctgttgaaggagtcctagactatatttatataagaccccacctagccagaaggcatcaaatttgaaaagtgctgaatcatgccctggtggtgggccttcattgttcagcactgcccgttgcatcttggacccctgagactgggaactccttgattggaagaactgtagtttgggtcattcactgggctggacttatagacaattccaatgaagtttgctcgtgtgaatagctttttattagattttactaattttactaaatctattttctttttgtttactgagtcaaacttttaatatgatttggtaagaatcactttatttcgtgctgttaagctcaacatgggcaatttgtgttacttgtttaatcgggacgtatgtcggcaccttcttcaaaacaggtgtaattcccatgcctcagcgaatgcccctcccgagaatgttgtaaaccaaagaaactaagaagacttttcatctccaggaagtgaaagcaaatacttagattacgttaaacaaaccaaatattatgccaactagtgtgtttgggggttggggaatttaaatgggtatgtgttggttttttttccccacagtaaaatctgcctctagatctagactgagtgaacatgggttgacttcattttagtgtaatgcagatgatgttagctttcgtccacaaatgttaaaaacgcagtaagatttccttcctttttgattatggtgtaatgattacagctcattagagtttaatatgagacactgtccaacccaaggacatcgctaattattattactagccctccctctccctttgctgcattttaaagaactttattgaggtaagattttatatatcataatattaactcattttcaatatataagagagtgactttaataaatttactcagttgtttaatatcacggtaatctcgcccagggccttccagcaccctaatgagatcccttctgcccactcacagacttggtcctcgctcatgcccataaatggctgggctactttggcctccattgagttgcctttctctgaatacttaatccataactgaggttgtacccggcacagcttaatggctgacttgtgtcccttaacagtgttttctgtttttcacttggagtttttggttagtgacgaattgaacacttagatctaatggaagtattctatattgtttaggaagagagtccagtttcaggtagatggtttagttttatcgtttccctacttaagacagcatgtgcaaatagaggtatccttgatctgaatgaaatgctcttcttcaaatgcccaaggcatctttttccaaagaaattttcaaatgtctctggaggccatgactggtagatctggcctaatgaattttttagccctgatttttctcagcaaggaaagaggtgttttttgtttttttgttttgtttttttgttttgttttgttttgtttgtttttggtttttttgtttttgttttttttatttccccactctgggtttcttttcttggagtcacatcacagtgactgataatctgcaatgaagtgaggtcttcagaagtagaggacacttgttggctgcctgtaagtctgaatggcacaggtgaagaccacacacagcctcatgatgaccatgagcgctgagatctaggatgaaatcaaagccaaagaaatgcaaaaccttctactctgtaaattaagaacacagagcctacttcagaacaagcttccaggttggctaacaaaggttcttaagtagatggcatttaagcaaggcaggggaagtgtcgccaggtaaattttgttatgacgcacacacatcacagtcagtcggaaagagcaaacaaaccctgtgctctggtggaagataaggggcatgcttgggagacaggactagttggtactctgtggaaaagaatctggaaaaactgggttgggacagatgctgagaatgatgggaaatggagtgaatttgaccgtcatgagtcacaggggaacacggagtggtgatcttaggcttatattctaatcaagatggaattttctcgagatctgtgatctcgttaactttcaagtcttgttatttttctgaattagttcttccctttctcagtttcacgagtacctttgaattttagatgtttagttttagtatacagttttccatgtaaggtgtaatttttagatcttcagacagaacatataaagacatgaacactatggaatttttctctagaaagcctcaagttcaagtgagaactacaagagatctctaagcaagatgtttataagaaaaatctaaagcaagcactaattttaaagataagcaggagctggggattggcacaggagatagagtacttgctacaaaggtaggaagagcttagttcaaaccctcagagcccgatgtaaaaaggcaagcatggttatgcaagcctgcaacccagagctgaggacacaggaagtttgttgggggatattgttggatgttctgtagaagactctgtgtggagaaaataagacagtgttaaagcaagacatccaacatcctattctggaaaatacagacgaacatacaacacacacatgcacaaacacacacacacacacaaaacacacacacacacacacattaatgctataaaaaggtttttttttaaatgtgagcacattcactctatgtaaggcttatggagttcaccaacgacataaattcaggcaaatctttccgagatgttagaggatgctcattaatgatgcagatgtaggattaaggcagacgacccttccctgtgtattcctagtgtagaaggcgactgctaattcttctccttagtaggagccccagcaatggcagagccgatcgcacactttgtaaaaccctccctgcaaagccggcttccgtgcctgggaagcaaacactacctgcagagaacagattagtattgcactcttattatcaacgtcaatgttttcgcctctgaaaggacatgaatgtgatttaccaccattcatagaaagaaaaatcatttcaccatttcaagactccggcaactaagccgagtccttactgggcttcttaagaactcggtcctttcatagcccattggctcctgagaggactaagcagagggaaggaagcagaagatatttttacctgatcatagaacttctaaccccagctgcctgttctgcattactgagttcagagagaaggcaattctttggaggtaagctcgttactgcaaaatccatctggttgctaagctttgctaattaggaagatgttggatatcagtcaaatgcctcaagttgttaccagttaagggaagcaacagtcttagactcttgttctcatttttttcagatcataagtccgagatgtgagggttttcttttctgaagtgtgaatgttgtaggaattggctcagctttggcttttgaacccaattctgcctgtccagaaaaacgttttccttatggttatttattcagtaaatattctttgtgccctgctgctggctaaagtctttgctgctgtagaaagcatagcagggctagcacagacaggcttccacctgctagaagcatccacgttggagttctttagaacttagaagtgctctggctcaccgtttcccttgttctttaaagccatgtcttagtcagggtttctattcctgcacaaacatcatgaccaagaagcaagttggggaggaaagggtttattcagcttacacttccacattgctgttcatcaccaaaggaagtcaggattggaactcaagcaggtcaggaagcaggagctgatgcagaggccatggagggatgtttcttactggcttgattcccccggcttactcagcctgctctcttatagaacccaggacctccagcccagggatggcaccactcacagtgggccctcccagccttgatcactaattgagaaaatgccttacagctggatctcatggaggcatttcctcaagggaggctcctttctctgtgataactccagcttatgtcaagttgacacacaaaaccagccagtataggctgtaattctccttttaagccttatagctgtagtatgcagtagaaaagttatttcccctatttgaagtcagggcaattatgacttagggaaactttaaacatacattagtcatataagtagtaattgatgaagccaggatttgggtccacatgagctaggctatttcagtttcgttaatgcccaaatgatattttcacttttctttctaaatacatactcttctgtttaacttgcacctcctgtaagtgcctgttcatttgctatggacatggatgcatcttttatttctgtgccgtacattcctggaattttctgtttttaaattaaacaatagtaatgatcaggtgtcaatgatcagtaatacatgactagtggtcacaatactatatatatattccagggaccacaagtagcatgttacctattttttaagacaaaggttttcctgggagacactcaaccccacttatttagatgttgtctctggctatgttcacgctataaaagcagaatatagagctgaggagatggataattacaaaggagattatactgtcagaaaagaccaaggtatatactgtttcttacttttttttttttttttttctttttttttttttttaaagatttatttatttactatatgtaagtacactgtagttgtcttcagatacaccagaagagggcaccagatctcattacgggtggttgtgagccaccatgtggttgctgggatttgaacttcagaccttcggaagagcagtcgggtgcccttacccactgagccatctcaccagccccctggctatgttcacgctataaaagcagaatatagagctgaggagatggataattacaaaggagattatactgtcagaaaagaccaaggtatatactgtttcttaatctcagatattgttcaaagaaagaattctacttactaaaatcaagttgatttcagtgtgtgtatgtgtgtgcgtgcgtgtgtatgcccatgtgtatgcaggtacatatgcatacatgtggatgtgtgtgtagaattcataggacaacctcattcatgcatgtagatatgtgtgtagaactcataggacaacctcattcatgcatgcaaatatgtgtgtaaaaatcataggacaacctcaagtgttgttcctcgggtggtcccaaccaccttttcttgtttctagactttaggcagtgatgggaggcagggcctttcactggccaagaactgatccagtagactaggctacatgaccaacaagtcccacatatgtttggaatggtaagcggtcccgccttgcctggctttttcttaatgtgaatattgaactcgggtcttcatgtttgtgcagcaaagagtttatggactaagccatccccctcccctcagctccatctgtagtatttactggagacatttatcattttatggccttgggccagtcgagtaacctgctttttatttgcctaacataagtgctgacgttgccttgcatgttttaagagtgactttacatgatctatgataagcgcttacctaggaagacttagacttagttgctcaagtacaggttgctcagatttgaatcctacttagccctgcagcctgggaactgcaaaatcctgcacgatgcagcaatgcaagtagtcctgcatcctcgtatgtctctgtaaaactggggttgatatctagccactctgtgagaagcaagtggctcctagtaacccctgggaaccattgagcccagtttctgacagacaggaagtcctcagcctggagcgtgtggtcactgcggttgtagtcatcattccaataccttggtagattcagaacattagacaactagtgtttactaccagtcagacgtattaaaggtaaaccaacagattgacattttaattgcagtgtgatgcatctctgaactgttggtacaacagagctggggtttgtagacagcattctgttaccattaaaatgcagcatgaactgggtctcctgcttaaaatagttttgtgtgtgaatctattcccacatatcaagatatttgcaattaaactttatatctagcggcaaattgaacaagatggtactgaatgtcacgtttcaagatcgactgtttattccttccatccattttatgccccgtgggaggaaattcatcagtaaggggacagagagagagacacggacacaggtgactttttaaacacttgtgtttgtgaagctaaaatctccggtctaaaccctggctggcttatgttagctggctgatcttgtgaagttattgctcctctgtggataattactgagaagcagcagacaagtatcaggaattgacatgaagacatccccaacagtgatgaggcacatttacacactgggcacagcattattctctcggggcccagggatatgaacccaggtagctcaggtctgtccatccagatctgcgtagcctcttttcaccctgtgtggaaaagggcatccgtatcctgtggacgttttgacccactgacagagcatcagaagtaatgcatctaacaagcttcataaataaagccatgttgctctgtagggtataaaagagacgaagcttatgtttctcccccatctccattggtatggctcaataaaggcatgacacaagcagcctggaactcatgggttcttgctttgtctgtcatgctcagctttttcagactccggagaaacagtaaacatggcttgctgtgagtgtgccaaggagctcaaagctctaaagtgtgtttgggggttgagggggtaggaaaaagaacagtagtatgttcgttcttcaagagccagccataggcttttacctctgctctaactaaggcagagaatgcattcacacattcgaaccaaggtgtggcaccccctttaatgtcgggaaaactggtgtcagcactggccatgtaggtgacaggtggcagcctgttattttgtgccctgtggcataacagtcactgattctaagccattccatgcatgctttgcttgggctgaggggtccatgtaactgttgcttaactgtcctaatctggaaagcctactgtagcaattagtgtgcttaagacacaggactggggaatgaggtttacagagacagagagagagagtatacatatatgtggttttcttagttttagtaagaacttcattgacataatttcctatcgacaaagtttagtaaattcacaaagatctgtttgccataagaaaatttttgtgccttaagtaatgattatgtgtctacttaacagtttatatcgtaaaaacaaaaaaataagttccttaaaatgtaatgcaacaaattagagagcaggtaacatgattatgtatgtatacattttcgccttttcaattaatcattaactccagcagagtgttgttgtctcaggtaacaaagctctggttcttcgtggaaatatttagttcccttaatataagtgtccagaactttaaaagtggggtggattgcaaccaaaatatctgtttctgttggttttcagcaatcccgcccttctgaagatccgtctgtgacttccaggcatgtatcagagtagcgtgtctatcattttgtgtttttattaggagaatacggagaattccagaagagatgagactgaataagtctcaatgtgtgtgtgtgtgtgtgtgtgtgtgtgtgtgtgtgtgtgtttatgtatgctgaaacacaaaagactcattgtatgactttaaacttgatctctctgtgtcttggttgcttgtgctaggatcagcagcctgcaccatccctggtttgacactcctactatgtaagcagtgacatgtggaggaaactcttctctgatcgggtgtttcctcttccaaaggaatccattctccctaatacactgaggtgaaaggcaaaccctggtcatgggacagactttaagtaggaatgatgctgttctcagtttgaatcttaattcttctctgttagagactatggaaggaagccagccactgtggaaaggtgggcatgccctgtcttcctcagacagaaacgtgtttccagaccccagctcactggaagtgttcttttgttctcaaaagtgttgatgccatctcgaatgtcttcccaggaaaacgctgtgaaaagttaggttccaagtttgctttagttcattccttgattttttaaaaatttttttcagcattattttcaaaataacaaaataataataatataatatgaaaataaaagctgtagtgtggaagtcgaagagggccactagaggtcatatttctgagaagtgacgtttttataggtttaaatataagagaactattatctcagtattgattaaggcagaagtgttgtggtgtttttaaaaacagttaattgtatagagtaggaaaaatatgtattggcaatctgtttaaaaacagttcatctgttatctttctgtattttttattctaagactcttctcatttcccacatgaaccaaacgttttccaatttttaccagttcctcccctctcgtcctaaggtgcgactgtgtctctatatttttaatataacacatttcaactacatttaataagttagttgggcatggtggcacacacctgcagtctttgaatttgggaatcagactggaggattgatcataggggtttactgtgtacatgagccacgtcatgtgaccttgcttctctaaacacaggctagaaagccacaccctcccacactcgctacagcctttcaaggtgcttagcatcctttgcagttcttctccaggcacctatggctttcactgagcctacacaggagagaggggcgtggctggtcagagagagagagagagagggagagagagagagagagaggcgtggctggtcatggagcgtactttgatgaaattttagcaccatttcttgccttctgtgttttgaggatttgggcatggagacaggaaatttgaaacttaaggggaaagctttctttttctggtagctttccattcgtgcctgtgttttcctggtgtggcactgtcagatccctactgggctgtgaaaactaattattactgtagtgaggaattttgggagtcataaccactacagcttgaaataccagtcgtgggagttttacctagaaaatagccaaatgctacaatgtatttatcttcccagatacacacaattttttaaagcaaattcttccatctcattcggttagaaaagaaaatatttcccctatgacacaaggtacgccttatccttaccctgttctaggtttaaacgtgttgaaaacatgttgtgtgtccaattaaccacagctgacaggaagtcaaggttcttgaagcatcatagtggtctctgagctcgattgcagcagtctcaggggcactgactggtgtaaaacccattttacagacccatctccttcaggtgctattttataagaaacctttctgcatagggaggtgtgagaatcaggtcaagtgtaattacaatgacagagaactgcacatctcaatacaaagcccagccagcttgaggctacctgctacactgggtctcaatctggtggttgtgacccctttggggtttgaataactctttgacaggggttgcctaagatgattggaaaacacagatatttgcattgcgattcataacagtggcaaagactacaatatgaaatagcaatgaagatgttaatggttgtaaatttaatggtaataattttaatagtaattttaatgttggggggtcaccataacatgaagaactatgctaaaggttgtagctttccattaggaatgcagccttaggaacactgaggaccattgtgctggagacttctataaaaaattcacacacatcgtccttctgagtctatgacttcaataatgtgcacagctgctcgtgtgatttgctgatatttcaacctgtatttggaacatgagatttcatctccagcttgctggcctaatttgcatgattatatttagcacaacatgattactagataataaatatttgatcatttatttcctggtaaagattaattttcttatcgtttttatgactacttgttagcattcacaatgcatgatgaatgtgatttctgctagaagtatgtgattgtagcattggagttaacacgttctttaaaaaaggaaccacttgggctggtgagatggctcagtgagtaagagcacccgactgctcttccgaaggtccgaagttcaaatcccagcaaccacatggtggctcacaaccatcggtaacaagatctgactccctcttctggtgtgtctgaagatagctacagtgtacttacatataataataaataaatctttaaaaaaaaaaaaaaaaggaaccacttttctaatgtgttgttttaaattttgcttcatctatgaaaaccaaacgaatatttacctatagaatatagtttttgttcagataaattaggctcttggaatgttgctatattgcaattgttaaatttgtagcaataacttaattgggatttttaaaaaatagttttttcatgcttattttattaggaatataattcttttgtttgtttgcttgcttgcttgcttgtttcttcttcttgtcgctgatagtttagaacttgctctgtagactagactagccttgagcctgtcaatatagtcctgtctctgtttcccaggtactggaattggcgggtattcaccgccacatcttgatcatggttgttttaaaggacactgacatcagagttttccattattatggttgaatgtagaccacaatttatttgaatgaagtattgatgatcaacacactgtagtacaacttgaatgtctttaccttttaagctttatttcactgttaagttagatagcaaagctgtatttgtctttgttctctacaattagagactaaaattacaaaaacggggttttaaaagaggtacatttatattatgtatgtctctgtattgtgtttaatttagcatgtttcacagaacatggagaaaatcatgctttgggaatgtttttctccgcattctgagaatctgcatctcctaattttatccatcaaaccctagtatcggaaggcgctccatccagtggctgtctgccggatgctaaagggaggggctcacttttgtccagttcttccaggctcacacagacccatcccatcccctctcccacacattatgcatttgccactgtttaattccattacctcacctgtgcccgagttctggctctgttattcagtgagtgggagagactctgaggacacgccccttgtaccagagccgacaaggatggattttgctgacagtctctgttgactgaaggtggtgccagtggatccaaaacttctgttcctcttgtggccacactacaaacccagtgcaggacactgctgtccaatcttggcattgataaaaccgaagaagagactactgaaaagtaatatcacgttaggaacaaacgagggtgctataaagcatgtacagtcccagccctcaaaaggaacaggaggaggcccacagtaggaataccagtggggaatgctggaatcacgtgattcctcctagaaactggaaaagtcagaattgtttcagatgcttgtcacatggagtggattcccatggagttctgtttgaggctctccagggttagaaacccccaaataagagatggagctattgttctccttgcaacaaaaacagacatgtggaaagtctatagagctctaccttctaatagggaggaacctttaaaatgcaagtgagtgggttgctgctttttaaaccaatggggatatggaactgatttggggagacaggggcaagatagactgacaagtaaggtgtgttttaatgtaagataatgtgtggtatatattaataaatttgaatgtgttagctgtatatgttactgtttggagcatgacgggctaagggtcagaaaaaaatacacgaatagataatttcttagagttaccatggttgactgtcagtcactcttgcagatgttacgtacgttttcaggtttagtccgtggacaggctggaaacattaaacataaatgtgattacttatgcatgagtctaggcgatcatttactaagaaaaacagtcagaagttggagagaacgtaaattttggcatcacatcccgagaaatccttttttttttttttttttaaacatcagagttgactcaaggttgttttagaagatgcctttttttttaagagaaatttttgatgtgcagagagagagactttttatctttaaatcgagaaaacaaccttttcacttctagcccaaatcctgtagctgctactgcatcctacacattaaacaagccgagaatgtcttgttttgtggaagaggtgactctgaagtctgagtgggtcaattcagtccctcaaggaagacttaaagtagctgcttcctccgttcagcccaggtcaccactgggaggatcagggcttaagttgagtaagtatgtatgtgaacagccagaagatgtcttttctcgctaaatgtggttcccctctgattagaggtgtgctctgaacaagccgagaccgggccatgccgcgcaatgatctcccgctggtactttgatgtcactgaagggaagtgtgtcccattcttttacggcggatgtggcggcaacaggaacaactttgacacggaagagtactgcatggcggtgtgtggcagcgtgtgtaagtggatccttcctccagcctggccacctcttgtctttctcgccactggctctgctctttgtaacagatcgagtttccctcttgttcttgggaatgggcccactgttgctaccactaaccacatgcctgtcaatttctctaattaccagaagcctcctccaccacggtatgtccagtcatgagcgtatctctccgtctatctctaataaagcatggccttggatgtattctgtagtagtcatcatagagtcttctttcaactcctaggaacttctgactgcttctctttacacaagggctagagtggcttttgtcttcttcagtccttcctgcagatgcatagacatctgtgtctgtctatgttcttacatgtcttcgtgtttctgcatgtgcacatgggcagtagcctctcactggtagctggcttatggcactgtcttgataagattgctatagagaattcctcttatttcatcatggttttttttttttttaacttcattctgataatgacatttaattgaattgagctcatgtcacctcaggtgctatcatggtgtttcattgctgtgaagagacaccatggccacagcaactcttataaaggacaacatgtaattggggatggattatagttcagaggtttagcccttatcatcatggtgggaaccatgggacacatagttagacatggtgctggacaggcagctgagagttcttcacccggatcggcaggcaacaagaagaagagaggtactgggcctggcttgagcatctgaaacctcaaagcccacccccagtgacagacttctccaacaaggacacacctactccaataaggtcatactttctaataatgccattctgtaggggcctatgtggcccattttcattcaaaccattatactatgggtgcccatgctgttccctgaatgaacctcgagcacatattcttgccaagtttttctttttttctcatgcaattaggtagacaagaaatagggatcgggaccatttaataaaaactcttgccatgcaactgtgaggacctgagttcaagtccccagaatgcacataaaacaaatgtgcagtctgtgcctatctaatgctagcacttgcaaagggggatgggaggcagtggctggagaggcacctgaagactgggaccagctagcctggcctatgtagttgaagtagactgttccaaacaaggtagaaagcttgtgacctgtgactatcacatgggctccgtggcgtgtcacacatgaatgtgtacattcatgtgcacacaaagaaaagaataatgctagcaactttcagtggcacaaggctgaaggaaataacttacagtgtctctcaggaaacatccaactgtctctactgtgggagataatgatgtgaagtcctgatgacttcagtgtaaaatgaagtattccccgcagagagtcagtccccaagaagccatgtctcagatatatggaatatctgcttctattagtagcctttcaagcaaagtccttagttgtatttgtttattcttgatcacaagttggctatatgaattattcaagggtcttagtgacagtgcatgcctttcttgagagattcttgcattttaattcttgaatttgcagggagacatatcccttccctttccctggatatctgggaacattctggcaattttccaaccaaatcccagaaccaagcaaaacaaagacttgctctcttaagacctcacactgtgaggtagctaatatctgtttgggacctagaaaggtcttattggtctcctaggagataactccacttaagtactctgaggaaactagtagtggagaggctctgacttcaattggatgattgtagctcctagttgaagatacccaagctcattttcacctagaggttaattgggttagataactgaaacacaataaaggagtctggtgcctggagcctttggaacaaagggcctttgttacctcggctctaaagggtttagctgctaggtcaggatttcctggcaaagttctcaggtttccccccctttccctaaggtagggttagtttctggaatatcatattctagcgatcaggaagtttgctttatattattagcagagaacaattcaactcaagttttggacactgtcttcttacccaccctagtgtaaacccccctcatctcccttccacttgattactctgtgcagggagtataaaacattatataccttcaccaggggttggagcatgcatacactttatagatggatttgtaaaaatccagtgccttcaacagggtcttatgagagaaggtctgtagtcctgatttcatttttacagagtcgggttacaaggtatcaaggaagcaaaggcacagctgggtaccagactctggtctgattctcagaacctttggaggaataaggcaggggatgggaaggctggagagatgcttcagtcttcttttaaaaaaaaagaaagagaaaatttcaataaaagcaagagaaccagcgttcaggtctccagcacctgttgagcgtggtattgttagcacttagaaggcagggacaggagcatccctggggcttgctaggcagccactgtagccaaccagcaagctccatgttcactgagaaactttgtctcaaacaatatggcgagcaatggttggaaaagatctatctgctctccacacgcatgaatgtgtaaccctgtgcacataagcattacaaacacatacactacgcacagtaatacaacttttaaaagaaggaaagggaagaatggggttgaaggtcaggttagacgggtggatagtgaagaatggaagcctcatcacatatctgagccagacctcagaagcgtccccgtgaacaagtgacatatgcggagctactgctgaggaaggcgcagagagaaatgagggtcattggtgctaatgagggaaaagagacccctaagtcctcctgtagatttcccagtgtcctgtcagtggcagaatgggcagcaatttcacaatactgatctttactggtaacaaatctcacctgcatttccttggttctttgtttaggttttaattttagtcccatgatttccctcccagccctcaattttgtttgattgcttttgagtcctgtgggtgtgtttctgccatcattcccacctttctgttgttggggttttttttgtttgtttgtttgttttgttttgttttgttttgtttttagttatgttctctcgttttctccatagcaacccaaagtttactcaagactaccagtgaacctcttccccaagatcctgataaacgtatgttgtcactgacttgggggaggggcaaggggaagactatgttgcatggctgaatgtgtccttcccttgcatcatctgcttggcatgggttttgtgtgattattgaccaggaaccttttgatagatactattttcccattgtcttgcgtgtcatttcatccggtttttactaggcaacttcagatgttgggcagagagcatctacttaaaccatttacacttctgaacaaattcctttctgatttgtgttgttctgtgaaataccacacatagagtatttcttgatttggcagaacttttttttttaatttcccgaaagctgtcaacatgccataatttaatgaaatcatatttgatagtacaggtaaccccctccctaaaaatgtaatattgcttattcaagacaattttgtgtgcacatttcaaggttcctgtgttaaatgataactgtgcagcattgggaggtgaaaggtgagccacatagatttcaggactcccctcctccccctcccagagtgcacactggttggtgtgctatcaggtcttccacttagggaacttaatggaatttcctataaaaagacattgcttcaaccatataatatactcttggtcttaacagcgtcttgctttctggttgcccaatcagtctaatttcattttcaaatgtcatatctaacacatccatattcgcttttaaaattcagtctgtatttagaaatggatcccccctctccagggatggtctatattgttggtacttactgaggcttgaagaggaaacccaatttcagttggaaatgagatgattaaaattcgcctttgtcacgattatcctggaggggatggggggatcctaacctcaaaactaataagaaaatgatttttaaaaaatgtagtgtagatgattacatcatcctatactgttattcttcaggggcctccataagatattactgttaattcaaataatgggatgatatttgaaagatgtgggtttttttattgacacaataagcccatgtcctgatattgtgaaattgttcctctaaaaccttaagtctggcaagtgggtggtagaggactagggaaagtctccgagcatcacacccaaagactaggaaaacatcatttgtgtgtgtgtcgcgttgttcccagggttttcaaagattgcagatctccttctgacacacttgtgtaccttttccttgcatctttggtgcctatgagaaaatcagaggcctaacgctctctgtgcgttgtctgcaggcatcaaacaccagagggccgtgtctgaaacctaagggcactctggctgggctccacaccaaatggctccacactgggttctgacattttctaggttagacagtttccaaggttcagaaagcacattttcaaaaaatataagaaaccacacaaaactggaaaatgctaacatacctccccaacaaggtcacacgtatgaatagtaggcatttctcatcctgtcttgaaaacgatggtaattggttctcttccattttatttcctttcagtatgtaaaaggctgttggttttcactcttcttcattgattagaattaaacattatttgataatttatttttataaagtatacataaggttttccagacagatcctggaggcgtccctttctcctcccatctgcggtgtggtacagaccctaacatccttccatcccggggggatgaggtgatttttgtcagctttatttcttgtctccctacagagactattcaatcacagcaagtgaagggttttgcagtgctagtaccaacatacgggagaaagcatataatttctagttatttatagctgtgtggttgtgctgcctgccttatttatagctaagccacacatttgaattgaaaaagtcatggtcacctggaggtcaaatgcagatcgcagcctcgattctgaggaaatgtgtgcagaatgagaagaggagcaggcagcctgttccactggaaaacccaggcttatgcacggcgtcttcacccacttagagttaattgaatggcatctctttgctcggaggtgattggttctacagatgctctgtctgaagtgctgctagtgggagaataaatgctaagtaagctagaaaaggcccttccactgaactgctttaagactttacatacagagaactgtgcactgggaccgcatcatgaatcatttcctgacaagtcttaatgctctaaccaggcactgctagattttaacttctcccccacaaacaccaacactgaaaagcaccacaattttcaggacacttatttgtcgtgactgctctcccagagacctctgcaccacagggacagcgagaggcctgagactgaagagtggtcttattcctaaccatgggttcctatctctttgaaaaccctttccatctgaggtgaagaacctcctgtgtctcagcagcttcggacgtcagttctgcatctatttgacttaatacacaggcctcacctccaggccctcaatgcagttcttgtaaaatagtaaagttattaggtaaagatttgaccagcttatatttcgaaggtgaggagagcgttgcctgtctgtgtgctatctccatcagacctcatttcaaaagcaggcagataaactccatgatgaagacaaagaacattacaccatttttttttctgatttattttttattttattttattttatttttattatttagtatagaataaagtttattcagggcatggggaggggagacaagagggtagtagaggcagagaaaggcagaaagagtagagaagtagaagagtggaggccggccatgagcacatggagagagggggaagggaatggggagagaggacggaaggggcaaggggaaagagagggaacaagaagaaaagagaacaagagggcaagagctacttatttatttatgtatgtgagtgctctatctgcatttatgcctgcaggatagaagaaggcatcagatcccagtaaaggtggctgtgagtcactgcatgcttgctgggaatccaacccagaacctcagtgagtgagcgctccagggatctaccaggcgctcccacttttccaccatggtgcagtataccacagtaccaagatgtacctctgttccagtctagtattctcttcacccctgacctgactgagagtggaactacgttcatatatagatttgtgggtcacagatgggagatcctgttaaagtataaggatgcctgaagccgcagatgtttatgaccctgttagaccaacttcctagatcccagatgctgttgttctttgactacaagatcagatgtctcagtgtttttttctaatgtattgtaagctacggtggatacagaaggtagaccagcaagctctgttaatcatggtttacccgcatacccctccccacttccccgtttgtttcatcctggtttccattaacctggctatctgtagagatgctggagacccttgcttcttgtttacctctatcttggcattgtgtttctggtcttaggtccatgattacagcatatcagggggagatatggccccatacatggttaaaacaggggaagagatggctttgtccacacattgtgtgatccagtagtcccgaagtagttttttgtatcagaaggttatgatttgcaaacagtagctgactcatgccaacatgaatagggtctaccagtgttaccctcagccattgtccttggctagttttgggctattgttttaaattattcttcatttgttcttctagctgtgaaataatagccatcaatttgttagcacatcatggaatactaataatggaactatgctattctcttagactgccaaactatagtaaaaacaattatttggctaggcatggttggcgcacttctttaaccccagaactcaagaggaagaagctaatggatttctgcaaggctgaggccaagctgggctccagagttacttccaggctagtcagagctatataatgggacctatttcaaaataataataataattattattattgttgtttaaataattcttgcacagatatgtactccttccatcagctacttgataaaggcatggaagtgcatccattttattaaagggattgggcgtgcttttctgtcaggccgtagagtcactatcctatctacacactgctgcaaccacagatagtaaattagtaggtagtcatgactgtgtggttgccatggcagccagcgtcctaggagaggcctctgttggtgatgtacctgctatgcaagcatgaggacctgaatttgaaaatttgaacccccagcattcgaatgcggggactgcaacacaggaggagtctggaaccctggtgctagggtagaatggtgaagccagactagccaatgggcttgctccaagttagtgaaagacctgcctttaaaacaaacaaaaacaaaaacaaacaagcaggtaaataaaagagggagtggccgaggaaggcaccttacagtggcttctagcctttgcatacatctacataaaatggaaagcagctagcagcaacatgtctactttaatacacagagaggttacttttattagcccagagtgtgagaatgctaccactatgcctcttgagagactcggcaggataatgtaagcaggccacattcagtaatttacttacaggatcagagatgtggtcggtaggattaaatctcagcatatgagtgaattgggaaaggttgctctggaaggctgtggtaaatttacattcgctgtatctttaaggctttaagaagttaaggatccatcagcgctcactatcagagtttttgtgatacgactggtagtgaagactggcgttctgaactcatctgttaaatattgagtagttatgactgttcatgtctttgtgagccactgctaatgaagtcaaggaagcttccagcaaactaagaagaaacaacaccctacggctaagcgagtctgacttccagttactattactctcattttatgtctttctgcctggtggttgttcgtattcaggctaaagatagcatttaagtgcagggaatatagctatgaataaaaattatgctagcattcattcttctacattcatcgcacatatctgataaaaaaaaatgtcccatgtcagtacaagttcatagacataaaaaagaaatgtagcttgactggtgaagagtaaacagagcgtagattacatttttattgccttctgtccacgtaggacattcatagtgttctccagcaactgtgttcgaactggccgtaaaagaagagaggctcaagaacacacctctttaaaatccagtgtgctgttgaaagatcactcgcttctattttcctgttcatccaactcagacttggtaggggtggccgctatttaggttttgagtggaatgtactaagagttttagctagtttgaaattagagagatgaaggaaactttatattaaaaaaatgttttaagtggagatggcagtttgaaagccttgtcacgtggagattaaaatttcctataaagtccttctttataggtttacagttcactcatacataaattactcacgctgtcatagcccataactcgtagccatttcaagggaccgcattactagctctcaatcaaatagaattttcaatgataaggcagtgagttacataagtcttcactgttatctttgcttgccattgttgtatagataagctgcattctgccaggggtgggggatatatcaaatagatgctatccgtggggaattttgtctaggaatcactcccttgtgttgtagtttagatggtcaagggcattacacctgacccccaccacacacacacacacacacacacacacacacacacacacacacacccagcatacacaaaacaaaataagtaaatctaaaactaatattaaaagaaatggtgtcaccttgcaaattgaggagtcaaatggatatgaaaactgtagggatttttttttaatatcttaattgtcggtgtgaggatcgactggagcccagtcagtcctcagtctccttatctatgcattcaagcaaccatgagtcaaaaatgaatgcctctgtactgagcatatacaagcttttttttctcgtttctcaaacaatacaggaagaaaaaccactccctttaatgtttgcattatcttcagtaatataaacagtctgaaaaaggacagtgtagacattagatactccaaactatatacaaatatacaaaagggaggtgggcaaactggagtttgctctctatagcgaaccctggaaccaaccgcctctgcacacacccaggcacagttagcctgcagggagctgaaatcacagtgagggaaattggtgtatgaagagtcgggctcgatcatgcctgtctgtgaaccctctgagctgcatagtgacttcagccactcccaggaacctcagtgggtttcacttttttttctttttttttttaatgatgtttttttattagatattttcttcatttacatttcaaatgctatcccggaagtcccctataccctccccctgccctgctcccctacccacccactcctacttcctggccctggcattcccctgtactggggcatatgatcttcacaagatcaaaggcctctcttcccagtgatggccaactaggccatcttctgctacatatgcagttagagacatgagctctggggattactgattagttcatattgttgttcctcctatagggtttcataccccttcagctcctagggtactttctctagctcctccattgggggtcctgtgttcccatccaatagctgactgtgagcatccagtaagttcctcacgtagtaaggcctttcccaggggacagcaactacagaaaatggtgtcgtgttctcaggatagtgttttttgtgagagaccatgcatcatgaagactcagaaatccgaagtaagcctgttccccaccaaccagaaaatagacgtccagtggatcttaaaaagacctaagactgtacagcgggtactgtgaccagcactggtgaaatggactctcacatgaaacttactctcataatattcatcttcctgggctttaggtttaggtagcgtagttttattatgagaaaacagacacacccgtgtcccttcgtgtatgtgaccagcagaggagggagactgcagaagacgtgtgtgtgtgtgtgtgtgtgtgtgtgtgtgttagcgctcgcaggagcacgcatacacatatacatatacatttatataaagaattctactctgaggaatttacttctgtgatgtttgtggatactggtaagtacacgattgactccaagccatgggaatcagaatgttccctgtccatgggcaaagaccagtgtctcagacaagaatccaaaagcacacatacctcctttggcctttttgttaggttcaagctcttggagaagcacctgaagagatcttcagatccagtagccaatcttatacagaaacacccttgcatgcctacaccaaaatgacgattgactctggcacgctgtaactcattcaaattggcacatgaaatgagctagcatagcgctataccttcatgaagcagagtaaatggtaataacaccatgtgttcatttccatgttcctgtaagaaatctatttgaaataaccctgatacccgtaaacataccccacttgctcgtatcctgattattattttattcttatttttgcaggcctacattttcacttagcccaatcaaggcaggttttgctaaggggaaccataatcagatagtacttacagcagattctgtctgtgcctgtgcgttcccaccgtatggaacagaaagtgcaggttgcctggtcacctccgcctgttgctattctatttactagtgtttactgtagcttctcattttcactctgccagtaagagggaaaaaatggttaggtccgtgggaagcaagttttgataaggcggttaggaaacacgtgtgtattgatttgcttgaggttgtgcaaagcaaatatatttgtctttggaatcttttctgttatagacagtacttaaaattgcagatcatttttcagtcattcaggataagaaaccatatattttatttacgtccatgttctgtgtggactatatataagttgaatttttctggggtttgtttgtttgtttgtttgtttgttttctggaaaatgtgttgcttttcctgtaggtgacattgcatagtcctgtgttctaacttattttcagtgaattagaagtaaatatatctgattttccccaaagttagcataaaagatttttgtgggacataatggtaggcaatataggcaccggcgtgcgtggagttaccctgtgtgactaacacttaattgtgggatgcaaggcatgttatcaccactagataaaaatcctaggatgcagagtgctcgggtcacttgccctgggtaccagctggtgtaaaaacattgttcacacgtagctgggcctaatttccaagtcctgagtggaccttccttccctctccccattgggcaagtgttcccttttttatcagctagatgaggacagttgtttgaggttccaggaataaatctctgcctccctccttctgctcaaatgccacacctgggcagacatcccggctgctgttaggtttttgaaaagttatgattaaccagtgaccacagaaaaaggaaagaaatcagaatgcatgcctctcgtgttaattgaaacgcactctggtttctgttaacatggtcaaacctttgattctaatgccagtcattttcttaaatatatagacaaggtactatctccatgtgacctagctgtgacttctcatctagttgccattggagatactgcatcccaagcctctttactccaagaatttgatgaacagtgtgaagagaatatgcgaaacagtggttgatattgttgaatgaacattgaaagtgatttgagaaggatgatatcatttcctgataagggggaaaccacattccttttaaaaactgtctctttcctctctgtctttcttgactcgcttaaatacttccaattcttgcaaaccactactcgttcgtgagttagaatattcttgttttatagttcagtcttcggttttcggagcatccccgttgccaggtaacatcacagtgagtgtggcaattcagatactgcctggcagtattgaattgaaagagaaatcactgtctatttgacgaaccttgcgatgaattacagactgttgccaagtgtgtgaaggctgaatgtccttgcgtggtttcgaaactgcacttgttgatgtttatgtgacttcctgtggtgttctagctctctcatgaaaggtagcgtcgtaattaggctgtctaaaacacaatgtgcggaattcccatctcgccgagatgcctcgattttgcgatcgccttcttctcagattccatttgtgtctgcgggactttacaatgatgctggtgataccattagctattctgcagattacaaaatagccaagccgagcatgaggatttgatgaaacatggccatattaagcagtggatgctggaggaatgcctgtctgggaaaggcatttttaatgctatagcttttaaatgtgcttttcttgctatgttctacagaggtgaaacttgctcctgccatggtaaaatgtctctgggtgcttctttcggctgcattggcatctactgtgtgctcctctttcacacgatttctctgtcctgggaaatgactggctttcttacaaaggttgggcaccctgtgtctcttctcaacttgcctcccatctcctttctagttcccacgacagcagccagcacccccgacgccgtcgacaagtacctggagacacccggggacgagaacgagcatgcccatttccagaaagccaaagagaggctggaagccaagcaccgagagagaatgtcccaggtagggaggaatcttccatcctctgttgttttgttatatagggaaatctgcgctcgcctctgcctcagctgggtagacataaagtttaatttaaatgtttgctgcaaggccacagattccccccacatctatccctgtgcacggtcacatcaagtaaaggcaagtacaagaggattttgaagcacaggtccaactctctgcgaaagagaggaattctgtgaagatggtgaggtgagggctgttaattgatacattgtaggaaactttatcttgtgtgtgagtctcatgataggctgtgtactttaaatgtgcgttgtaagatatacttaaagaataaaaaggagtagttcaaatcagtaaactagttcctattgcccactaagctcgaggacctgagtttgattcccagaacacacatttaaaaagccagaccttgtggcctctgtttttaatccagggctgtgggggcagaagacaggcagcctgtctaatctgtctggagaggtccagccccatgacgtaagccgtttcccaggaagtgtgaggtactagaggaagaacaccgacacctttaagctatgccttattccttgggccaaatcctagctaacttctttatcaggctttgggttccaggctccaaccctgcaacaggcactattgctttgtgaaatctccccatgccatagaactactgcccagctgagccaaccaaactagttattcctaagctggcttacctcaagtctttactcctgcccctaaatacattctaaggtgttgctcagtcctcccgtctatcctcccgtcagtcctcccatcagttctctgcctgagattggccctggccctgtgtccctgtaaatcattgagtcttcttcatagaactcatctcctgggctgttggcatcccaaacaacaagaaaaccctcattttaagcagaactaacgatgtatctcaaaaagcaggacaaggttgctatttcttcaaagacgactagcaataaaagatgactagctataacacttggccctactctgcagttgtaaccctgagagaaaaggttttacaactacactgaaccacaataatcctggccatgaactatcacttacatcctaccagttggccatgagctatcattcgaatcctaccagttgcccatggggaaagcctgaaagccagttgagctagaaagccaactgaatggaacaggcaactaaaagcaatcctctggaaaactagaacttttcacatttttttttcattagaaaagtcatttaggccaggcagtggtagcctttaatcccagcacttgggaggcagagacaggcagatttctgagttcaaggccaacctggtctacagagtgagtttcaagacagccagggctacacagagaaaccctgtctcgaaagaaagaaaaaaaaaaaaaaaagaaacaagaaaagtcatttaggaaggtgtggaattgggaattactacaattccttcctttttagactcaagactgatctcattttctgaagctttcagaggctgccctgggcacataatggggcagaaggccagaggaagtgtaataaacactgagcgctcccgtgatgtttccagcccctgccagggcaccctgatgccagccttgcctccagctggaagctcctcccctctccggctcctctcctctctggcctcactttgctcttgacattggcttactttagaagtgcctttcttcttcttcttcttcttcttcttcttcttcttcttcttcttcttcttcttcttcttcttcttcttcttcttcttcttcttcttcttcctcctcctactggtgggaggtggctactacaaccttttttttgatgatgatgattattataatcgtctacttggtggtggtggcattatcagaagtactactacactcttattacttcttactcactcatcataagatgacgaagaccaacattattcctcctcctcatctgcatgagaatcatgattaataatatcatcacctcctccatgatattcttttgttaataataaaattaataacaaggaaaagggcctcctgccgacatgagttgctggagtagtaataacagtggtgatcatctttcatcgccgaggtcttagtcaagtaggagaagaagacgttcttcatcttcacctccatgatcaacgactacgtacgcgtcgtcactactacaacagataatgctgctgctcctgctcaccnnnnnnnnnnnnnnnnnnnnctcctcctcctcctcctcctcctcctcctccttcttcttcttcttcttcttcttcttcttcttcttcttcttcttcttcttcttcccacccacaaatctcagcagatccgctgctgcacatcttgcttgactcagggcaagtggttactcgaaccttttatttgattctaaagatttatataatagtttacttattggtggtttctatatcatatgttctactacactctaattccttttaaatcatacaaaattatataaggcataccaactttatatttcctccttaaatccatgtgaatcattttttaaaatattttcactttctccaagatatttttatgtaattaagaaaattagtttcaagtagtgtgttagcttctgacatgatatgttgtggaaataagaacactggtgagcatctatttaatccagggcttagttcatagatttccgggagactttctccatcttcacatcccagatcagggactacttagctgtagtcattcctagagcagagaatgcacctggtagtccccagtgttacagcgttagctgccatctctcaccatagtctctgctgctcaattctagggactttttgactttgaacttgtctgtctcttaaatctctacttagtaatcgtcattttctctgcatgacatagccaggcctctaaagaactgtaaatcctgatagaattggtgcctctctgcacacagtgaaaaactgctggacagggacccacagtgcagccctgaagttcagattcagagaacttcaggttttcaaattcggagccttccaacttgacttttgttgtagctttcaattagttttctgggttagcccccccaaataatggacctcatctctttccactgcaggggcagggggttagggaagatgatatttgtattgatgttgatggcctggtgatctgaagatcttggttacagtgtgactggcatgtgtcagatgcagataagcacacatgcaaaacccaagcgcttcatcactgtattagtgacttcttggtatgccaagcaacctgagaagagcaacctaagaaaggaagcctttgtgtgggtgtagaattccagggtacagtccagagtgacacagtgagcatggtgtgaggcaggagcttgaggcagcagcaggtcacatggcacctgcagtcaggcagcagagtgcatggcctgctctctcctttgcctcctgtccagaaaccccagccacagcccagtgcttcttaaatttagggtgagtctccccacatcaactaacctaatccagaaaatccctgcccctgacatttccagagacttggttccctaaatcccatcaggctggcgagcaagatcattggtcacacttacttctatatctagtccatttagtgtgcatgcagaatgaagtccttcaaaacaaaaacttgcccgatgctgagttttttaatatattcagtggcatcttagggacagctactggtactgacccttgacttgcctgtagatagatctgcagcagcacactgggccaggaggatagtaggctcatcatcactcctcgtccattggttactctcacagctttcttaaacaggtctgtagagtaagattactgagtacagagcctgctgtaatcaggcatcaattaaaccagacagattttgtaaagcactttacccagtaatattatctattaccagtgcaccctagtaaaagccactggttaagggggtaaatcttctgcctacagcgtgtctgtaagtagtccttcagtgacgacataggccatggatgtgtgagagtagaagatgtttgctaaattattctgaaaagtcaacattcaagttcatttatatagtaatgcatattttcaatacattacctaggtaaatcttaattatttcatggatctgcaattccaagagggtgatccaggttccgaatgtctaagataagatgatagcaaagatacataatgcaggggaatcggttttcatgccccagtaagacatttagtttctatctcaaactaattttgagatgtcttgcctgaggaattctccttagaacatcgccactcgggaacgttcccttccatacaggaaattgaaacatttttcttcccaggctcatctataaagcgaagcatctcttcaatatcttttcgtccaacgctgccctttattagctaatagaaatactcaagtacctggaacagtttgtacattttccatgtatcttgttctcaagaaactaatttaaaaaaaaaaatccaactcacgtgctgatcggataagaccttataagcctggttttcctcacagattcgggagatggattaaaaagtccacgaggacctactctgtaatcaactttgtatattgcttcatcttcctccattaggcttacattacagcaggctggcctgcttcctcaactagtgtcttacctttcaccacattcaggagattataatgcatactttctggggctttctgggtggatttggaataatccccttgctactcatgacttagttactgaacaggaagagtccactcttcatttgtgcaaggaatagactttggcattgtattcctggtttacacatacacattcccaaaacataccacttggaatgctttgacttgatgtcgtaaaaggttaaaatcaatgtcttagtttattgatgggagacttcgctcagatggcatacgccttttatgggtaatcagtgtttactcacgtcaagtaaaatgactttccgacagttctcaaggaaaatggaaagatgaaccaaccttatttcgggagactgcaatacatgtaggcatttatattcaccataccgctggcataaattatttatattcttgtaggacaaatattagtcacattgggaggggcatgtgatgtttttttaataggaaacatattgtcgtataagccactgtgttaaatctgtatttgaaaggacaatgggggattttcatattgccttatgtcctctttataggtcatgagagaatgggaagaggcagagcgtcaagccaagaacttgcccaaagctgacaagaaggccgttatccaggtaacaccccggtcccacctacaccagacagaacatgccactctcagccatcaggacctccaggaatctgctggaaacccctgttttatatattttcatgaccttcacttgttcttcacttcttgtcttagtaataagttgcttcccttacattttctccaactatttaaaattagaactaatcaccccaaatatattctatggcttgcaatcttctttccattaatgatacatcttttgagagactgaagttttcagctcctccagtaaccttggaaaatttaagtgagattaggaatttaggactaaacccagtctacacatgacctcgtacaaacagagagaaactatctttgcactaatcgttatgttaagaaacaaatatgtttgtgtgtgtttttatcatatcagcatttccaggagaaagtggaatctctggaacaggaagcagccaatgagagacagcagcttgtagagacacacatggccagagttgaagccatgctcaatgaccgccgccgcctggccctcgagaattacatcactgcactgcaggcggtgcccccaagggtaagtcatattgatttgtcacttcaggtcacagcatcaatgatggtgtccagacagtggagactggaggccgcagggaagaagctaggagaaatgccacaagcactttatttgtagatgtgacttaggtacattgtatcctaaagacatggggtaatagaccagtgttggccctccctctcttaactcttttggcagttacctttatactgatttccatgctgcattcttatttttctttaagccatcattttttaaaatcttttttatctaatgaggaactattatacttttttgcctaatatagtcatgagttttcatagtcatattctctgttcacatttaccatgtatcatttttcttcttgggcatcctttatgttttcaagtgcagatgaaatgaagtttgaattctttgggttacaatgtgtataagctagtgatttatttatgcctgaaaaacaccttaactttaccattggttttaaaagatatttttgctgggtatagaattatcagtcgaagtgattttcttttactactttaatgatgtttgctgttttcaacagaccattcttatcacctctacagataatcttttgtttgatctggctgtgctagaggtttttctcttttcacagtagctattttatccatgtaaaacgatggaattccatctgtccttagtctcttatgaccatcccttcatctcatacttaagattatgtttgatattttcgtgcataaatttttattggctatcataaactatgaaatgttgttggtgctaggtacttttgtataactatgaatatattcagactttgatttgaaatctagctagttttcctagaagcagcttcaccctttcgcattttgctctttttagatatgttaggtggagtgactcttcttgtaacttgttatttccattttcaaatcaggatccttaatagtctaccatgaactctgagtttcaaattggattgacaagaaccaggcagtcatgtgtctgtgggacttcaggcactattacctctaatcttctgggtaccttttacctctagcctctgtttcttataccagcaggcactgaatagtcctcagctacagtcagttagtaggataacctgcagatctcttatagagcacctgtcctgtaaagtctagccacctgggtttccaatgctctttccttcttggggtccactgcctgagagccctaccttgtacagtcagggaagctcagggaccatggttgctgacagttgtaggacctcaccttgtgtatctcctcttcctctctggtccatggtccgtactctgcagaaactgttcctgttatgtagtccatctattccttttctctggcaggagggtgaaattttggtcttcttagcagatcttgaccagaagtggagatttgtccacattatgtaagggaacccaaactccacccacccacttgtgctgatttccctcaccacactgatagtcctttctcagttaaggagctcctggcattcctccgggtatcgagaggacactggttcttttgtactgatgacatcactgtgatctcggaggatggggtggctggttcagggtgataccagtagtcatggacagagaaagctgagagtcagttgcctgctgcagtgtctcttctctgggtcacacttcctccctgaacaaacagcttctgacaataagatgtctatattagcattttgttttctgtgagcaatctctgtctttcccaggcagtacttagtgaaatcctgcttatatctctttgcagatgacaaggttctgggttactctttctttagagagcatgctttggtgaggagagttgtgggggtcatttgtccaggcaagagctgctaggtagatttttaagccgcaggcctgagtcttggggcactgactcctgtgcataaagttaccgaccttgagttatttaaatttggactcagccactgcagatagctctgtatttttgaaaggtgttagaaaactctctcttcccgattgcctttgtgcaaatctctaaaaagatataaatcaagagttttcattaaatcttgtaattcgatctacaaactgtgtttggatatgctgcttataacaaccacagagccataacaggtgatgagaaatatgacttaaatgtgcgctgactatttgaacacaaaattaaaagtcaaaaggtttttttctcttttaaaacagtttaatcttattctaaatgtttgccaagcttcatagacagatcttcctcaagaccagtgagaaatacgtgaccaggggcatatgtgtcctagttttaattaattcaaacagaaaattaaggaataagcttggaagctttcctgtttctcaaaatgtattccttaacatgttccctccagagaggagctgccctccggcacttccttctgggcacgtcttcacgggcagctgtccgcacctgcagtgctgggatgctctgtggaccattcctggggtgctaatatctgcttttttcttttatctttgaaagtgaaaaaattactatgaaattacaagtgtttagatacttaaaaacattttattgcacacaaatgaaaagtgattgttaccagagtttgccctagagagcagggagttggtaagatggcctctctctctttctctttctctctctctctctctctctctctctctctcttgctctctctctctctctctctctctcacacacacacacacacacacacacacacacaccactcttaaaaccatttccaggggtacatttgcttgtttaaatttaacatgcattctcatcgagtaataataataagtgtcagaataagagtgacttgaaataaaatataaaatataatcagttcagttgcagagaaagttatgataaggagaatttgtaagctaactagtatggaaatataaagtttctgatatgtaacttttttctttttttaaatgattttggctgactattaatattagtggtagtaaccaagctgtgagaatgattagtggtgtggatgaggggtctgagggaaacataattgagaaatttaggccattttcgtcgtttttgtgataacagtggtaggctaaggagacttactaagaagctataagaggttacgtttgttcagggtatttttttggatgattgtgataatcaagttaatgggagaagtattagtgatggtaaaataatttttagcattgtagaaggttagggttttgtacatagtctgttccatacaaactcatcagttataactggattctaagaagtcttactttagttttattatataagtgtttttaattaaaaagaaaaaaaaacagaaaagaactttccgttgtttcacaacagtgtaggcgttggaaaggagggaatgtagtttaagcagcctaggttcattcaaccttggattgttgcttcattagagagcgtttgaagaaagagcagaggatctcaaatgcgaatatgcaaaattaaaacagattgttgtaagtcaccctgaaaaaagtcaagaatatgtcacaggtggcatttgttggatggccagacctcttggcaaacctttcccggggtctgtgttgctttaaaacatcttttgttgactaattcatgcttactctgtaggctctgccttctgggttgtgttattaagcctgtttatccccggagagcttcggtctgtttggtttgacaaaacaaggcttaaagatgcagaagtccatatcagacctggcctttcagtgctgtggggttggagggggttagctctgtccccagtgtctgtacagctaacatttagctgaaggcatgggcttcatcgcagagctgtgggcaagggctaaatctcagtctaaaccgaatgtcattgacaaaggtcgctggtttgtgggagaggactgcaatcagtctgttttccaaaggttctggtgttatataaagacctgtgtttaatggccaagatagccatttaatctgtaactagggacaagttacttaacaaaggaattcttcctccccagtctgcaaatcggggttaaattttcaacattgttgaaacagcaactagcgtgtttctagcgttgactggccataattcaaaaccagaaggattcactgaaggttgagacaggactgtagagagtacaaagatgtcttccttcccaaggggtctgcgaggtggtatggaacacatggaggctttggtgactgtccagttgggaaggtttgcttcttagttaaagaggagccaatgggcgatgacgtatcggaactccttgcatgtgcgacatgtctgctctagcagtgtgaaccctgcacaaaagacagattatgcaaaacctttccatgtaacacatcattattatctgaacagaaagaagcctccaagaataatctattgccattttctctactcagtggaatttgtgtttgacctacctagatagttttctaaagaaaaagattatagatacattttatatcaggctttaaattttttcactcaatcactaaacttaactgcaaaagaaaaccttattttctaaaatttgcaatgtaagtttccccaatcggttttgatttgtttccttggtttatttttgtttgcgttcatgttcctggggtctccttctggatttcttctcctgtgacattgagaatatgtatacaaggttgatggcaaaatcgggaatcaaactcagtaggagacagcacaaggtgtagctctctcaagtgtgtctttaaaccaccacacagttgtttcatacagttcatgtcatatgctgaatactttttgtactctaagattaagactgcaaaaatctgtggccttataaaaacaggagaaagttactttttttcctgcagagctaaagttcaaggtttcagaagccattagcatgcaatttaatgtttcagaaagggtttttatactatttaaacagggacaggtcatggtttccttccattttgtggacaccagcctggtatcaacatgttataaagacaatggatagatatcttttggaattagtgaaatgagcctcattaagagaaaaattggatatatctggactctgttaggtattttctgggacgattgaccacttcaaacaccttcttaaatggatggggatactgagtaaatacaccaagtgggtttggaatttcagtgtggtctatgaacattgggagactgtttttctcatctgagagatattcacttgcatgaataagatacaaaggatagtttacaggccagaaacactgctgaaattatacttggctctgagtcacgcatcagtttaattaacagtaaattattagcagctacattgagccaggaactatgctgggaggcaggaataggccatgcctttgttcctatctcagaatgtgtgcattctgctttgccgtgagttcttgtcttctgtgctctcattgtggacgtcatctaatccgtttccttactgcgtatccctcatctttccagaaattaatttttaaatgcctcttttaaaaggcagtgtgatcccaaggtgaaggaggtgacaattgaaagggccacatcagctgcagagagaatgcagttacgggacaaagatgcacacagaaacaatgaagatgataataagggggctgggtataattggtcccaatggggcagatctgtttctttattcttaaccatgagttttagatcccacccattgccagtataaccaaattgcagtattaatacttaactgaaataagaatttccaagtaaaatacacatgaacacatacatgtacacacatacagcacatacattgcacacacaaacaatatgcacaaacacacatacatgtctgtatatgtgtgtatatagagagatgcatatagatgtgtgtgtgtgtataaatatgtgtgtatatatatatgtgtgtgtgtgtgtgtgtcactagttagagaaaatttcaagacttaatgttaatgaatattaaattatttattatcaacatatttataatgagccactgaatttttgcttgttctgtgaacaattccattttgaatgtgagtaacatcaggctaacagttattaacaacaattactttaaggcaatttacttgtgagctctctatatagacacagtagagataccaggcattctttttttctaccattcttaagtggacattttttcttttttttaattagaatttaccaaattcatctttgtcccggcataatcaaatgaagatccctagacaacgatggttgctcattactcgacaatggattatatagctctagaaataactatcgtccaccttggagaattgtggctgaaagttgtaaagagggctgtccctctttacatttcatttcttttcttttcttttcttttttgaaggaaatgcgcatgaatcatatgccaaagccaagccgttttctttgtaacaaatgaaaacataataatgtggggaaatgctgcttgttttttaattctttatctacacacactgtctgtcctctatgaggtccggacacacaccattttaagtggtttgtctgcttgttctccaacgtagagattgatctatctaactttttaactttctaaacacgatccttgcaaattgccagctcagagcaaccaagcagaagccagcagctaggagcatcttacggtcttcagagttatctgatgtcagcaggctttgctcatgggggtctccagactcacaggatgatgaggtcagagctcattctgagcccccagggctcacggcgcatacaggtctagggctgggggatcctcgaggcctgctgtgctattgctctgtatcaggctctgggggattttcagggtaagttaggaatatctttccaaaacacacaaagaagtagtggtgttaagcgagataagagcttgaaaccatgtgaacacattctttctttaattatcaccaggcttattagaagataaggatgaattcagaaggcagacccatgaatatcataaaagcccaacttgtacctaataccttgaatcacttttcagtaatcttctaatgagattgacaggggacgttcctatcttctatttctcctttctgcttcagacctttagcaaagtacaacctcctgccaagagcctaggaccagaaatgagatacagtaatctaaatccagatcttctcctctgttaaaaagaactgcagtcagagtgctccacaaattcagtcctgttatctgccctggccacagtttcatttttgcacaattttagtttcttatggtcatcgctgtctcagaatattaaatggaaaattccaagtgccagccataagtttttaatagcttttatttcaccatattgctgttgttttattggggagtgttggtgttttactgactaatttataaatcagtcttcatcatagacatgtgtgtatagtaccaagcacagtcaatgtacaatcggtacctgtccctgagtttacagaactaggaattcagatgagaactcccagaacacagtttttcactctccagttgcatcattgtcaagcctatctgcgccttgatagaaatctatcatgttaaattctaagatgggctcacatagtggccaagggtacagagctatggaggcagacagcttttgggggaacactaagtgtctatgccacctggacttgtgtgtcccttacatcatcccttcaggccaagcattaacatccaactagtcaactgacgaaactttttcatcctgaaattcctactccccttctctctctctctctctctctctctctctctctctctctctctcccccacccccccccctggggacggtttatgtccattgtgtatggctctgtttgtattctaaggcacaggaacgtggcctgtaccccgcatatttcaagtacagagcaccaatgccgggttgggcaccatggatcggagctcctgatggagctcctgatagacaggaagtgagatctaatctggacctgtggctgtcactttgaagagagggatctagcataataacggagtatactgaatgcaactactgggttttgaacagcaattcaaggtagaacagagaaagggcaccaaattccacttagaattgccaggagaatgcctcaaagttatatatatgcttaataaataaatatatatgtgtatatatatatatatatatacaaattataatacacagtgtacattttggggctgtgcacaaaacatgctaatttgatatatatcacattaccatgttttatatatatatgtgtgtgtgtgtgtgtgtgtcactatatataaccttgaagcattatataatataatatatataataatatatgataataatatactataaattatatatagtataataaaaacactgtaattcaccctcctatttactccacatatacactcacatgtgcaaacatgtacatagcacatatactggttcatatatgcatatacgcatgcatatgtacttaacatacatagtttctggtaataagttccataccatccaactgtttctctaggtgttgaacacacattatttaatagctgtatttgtctaaacattcctggcatgtcttcgtgaaggatgtatacccttgtgcatcatcgtctgaaatcctaggcaggataccaacagcagcagaattgctcgagacaaaggaaacttaaatcctttttaaaaaatgtcttcatgtaaaacctgaataaattgaagtagaaccagttagaataaaaacacacccaagaagcacctaagaaaaaacttaattgtttctgggagttttagcatctgattgtttgaaaagagcttaattcaatttcaaagtaacataactacagttcaatgagggcctttgttctggggaaagataatgtttcatggggcttatcaggcattccttgcccgacagttgaagagtagttagattgtctgttattttcttattttgattattgcaccactgtaagttactaatgaaaggattatttgggaagcactaattctggtcttggggctgtgcacaaacatggtaatgtaatctcatgaacactccatgaatatttctgtggttaaatagaaggatcttactgaaaactgagaaatccaaagcttattctccctctacagcagaaagcagctatttagaaagagcgtgctgatttaggacagtgtcagaaatactaaacacgcatataattcgtaaagaggaaaaacaggctgggtatccatttatgaagaattgggagaattcccttgcagtgcacacatcatgggacccttgaactcaatgctagtggaagaagtgatgttttgctcacacttgaaacccatgttcttgcggttttcctcacagcctcatcatgtgttcaacatgctgaagaagtacgtccgtgcggagcagaaagacagacagcacaccctaaagcattttgaacatgtgcgcatggtggaccccaagaaagctgctcagatccggtcccaggtaagccctgagtgggggaaccttctgcagcttacagtccagttgttgcttcctcagtttgttgggaagataattacctccctctagagcacctatggtgagggtgttgtatctctttgtcaagagttctttaatatctgaaactctaaaagctaatcttcagaacacacagttctacaaggcttaacatgtggaggcagaaggatggatagttcaaggccagctcggctacttgagagagatgctgtctcaaagaggtgagaagcagagagatgactcaccagttaagagtgcttgctcttcttgctgaggacctgaagttagtgcccagcccccacatttcaccaccacttaaaactctaggttcaggggatatgacactatcttctggcttcctctggttcctgcacaaatatctgagtgcacacaaacacacatacatacacacatacataaataagctgaatcttctacaaaaggaagggtgttttagtactgtgtgccttgacattttcgaagtttcccccagtaatatggaatataaattctgaagtgttgagagcagccaaaatttttaatgctagccattcatcatttaatgctagccaccaggtctgggaagtggctcacagttgacaaagtgggaaccagagtttggatgccactgagtgtggtaacccaccagtaattctagcactgaggaagctcagatgggatccgtggaacaagttggttagctaacatagtcgtattagtgagctctgggtccgactgagaggctctgcctcagtgaacaaggtgcaaagcagtagaagaagattctcagtgtgagcctcaagcctctacacactcccacttgagtgtgcatccacgtgttcagttaacacgcaaacattcatacatgcacacatacatacataaataaacaaaaaataaaagaataaagtcaccaaaatggagaaaatgataactcagtaaacagaaagctgtgtactctaatcagtaaactatgcccagtcctggcaaactccattgtaactaccatgtttagggttgctagagtctagatgaagatttgtaattattttctgctttctcattcccagaggttgaaaaactagggtctgcctccagaaatctaagattttaaattttctcaaatgaaataaaactaaaaattgcatttgccttctatacaaaatatccaatcaaattgaaatattcctatgtattagaaaatcttcaaaggtatttctgtagggactagggtatttaggaagcttcagtggtcggagtgtggtgactgatgtggtcgttgaaatcgactgttacaagcatgcaggctactggtaaatactgaggaatgagagaataaaaaagaggcaaagaaaccaaaagcccctttacttcagtgttccagctgtgtgtgtgtgtgtgttgggcgtggtctttgtcactgtttccttagcagagattgttcatgtggaggtgccatcttctaacaggttatgacacacctccgtgtgatctacgagcgcatgaaccagtctctgtccctgctctacaatgtccctgcggtggctgaggagattcaagatgaagtcggtaagtgagctgtccttcggatgttctccgagagataggcttacccccagaacacatcagggctgagagtcttctgtgtctgtcacctgtgcccaggtgcctacgcgttgtacagtacattttgtgggttggtggagggagggggggtttcacacgtgtgtgaatgagtctaaaatccttcagtgcacatggcaaccaggggaaggaagataccaggtgttggaagatactaggtgttggaagataccaccaggtgttctactctatcaccccgttctcatgggacagttgctatctgaacctagagcttgggtggtggccagcaaagccccgtgatttcccttaatggtgctgggattccggggccacatgcttatacatggatgctgagggttgaagcatagctcctctcatttacacagcaggcaatctcgcccattctgccctctctagccccagatcgcctcttacagtgaatctcaccttggctgctgcttcagctcttaactttcaatgcctgtgagacctaaagatgtaacctggtatagagaagaccttgaagtcttcaagcagtgaatcagttgttgaatcccatgtcaacagtgatattctaatttatccaatcttgtaggtagatactcactaggcttctctactttataactaagcacagtagttttagcctaccctgtgtatcgagagctcaactccccatttgtttttcacttccttaaatttcttgtgactgcacgtttcagttatgtttggaagacagagatcagtaataagtcctctatataagaagtcaagaactgggtacagtaatccatgcctgtaattgtggcacttgtgaggctcaaacagggaattgcttcaagttcaagtccagctggtactacggagtgagttcaagtccagtctaggatacacagtgaaacctatctcaaggaaaagataaaaataaaataaatatatataaatgaaaacagatctccacaagggagaaaaattcaaaacataactcataatcttactgaattgaagttaaaatttctagatgtgtgcattaaatgagtgtgctttgtggttagcgtcaccctcttatcctgtgtgacttacattaaggtagcattagcaatatcaaactatagaacaataagccattagaaaggaactgtacctaaacccgctaattacagttggcactctctggtttctaatttgctctttgtagagcttctcatttggcattgtgctcctctaaatattagccacaagtgagtcggacagatggcgactcaaatccctcagtgctgcaaaatacccaagaacgggaccacccagtaacttaaaatctcagtggcagagagatggttaactagaatcacacttgggtttctgttctttctttcaataaagtaagaaactgccatgggggtagatcaggaacaattacgtaaaaactaggactggagggatggctcagtgagtaaagtgcttactggacgtttagaagacctggattgagatccctcgcaccaacatttaaaaaaaaatgtcagtcatgatgacatgtgcctgtaagcctactgtaggggcaaaagcaggtggatcgcaggggcttgctggccagcgctactgcacctgtgtcagtcgataaggagaagaagccattgaagaaggcatcccaacatcaacctatcagccttcgtgcacacacacacacacacacacacaagattcctgtcattctacatatactggagaccacatacttacagaaaatctttctaagatctttctcttggaatcctggatgctatcatcttaagatagttgtttacataggaaaaaccacttgctgcaatgaacacattacagcctgtccactacaggcctgtgtgccctttaagctcctgacacaaaagcttgaggtacgagttcttcaaggacaatgggcttccttggttgtccttagtgggcttcctgaagaactgtgacacaaacaagcaaatgaacagccagtaaaactctccatcacatcgatgcagacaaacccaaaatcggctctgtatgctgctcacaaaatcctttatattttaatctctttacttttgttcatatttgaagtattccataatgaaagtgtgatttgtttgttgttatccaatgcaaagaagaacctcatagagtccttccgattggcaccttacagtagacacagtcgtctgtggattccgttcacccaccatttttccctaagttatcaaacttgaggtttgaatcagttcggtatagataaggagaaagccacacttcagttggcagaagggtgagatgggaaatatagagatgctcgtgtgttttgggtaaacgttggcgcctttgtgcacctcaactaggataagctcaattcagtctacagcttggaaagaatgcagcattctactgcttaacactcatggttgctttctgagtaaagggttttaggctgaggatctgccagtatcagtttttctttaatgacacaggtgtatctctctcagtgaattatgcttccaaccttaaatctctattataggccaaaatgggtgagaagggggccttaactacaaagaagttatgctgtgtggttggaggtggggactggaatcaagcctgtaagaaagaataaataaacaaaccaaccatactgactaggaatcatgctgccagggaattctggccctgatcatgttaccccattgtgcttccctgaggcagcccatctggttaggctacagccagctctagtaaatcccaaatcggtagttctagtaaccacacacatatgggtggccttccgtcatccagcatcttgtgtgcctgagagactctggaccagtccttctcaaccttcctgatgctgtgaccctttaatacagttcctgatattatggtgaccccccccaaccatataattattttgttcctatttcataactgtaatttaatattatgaattataatgtaagtatctgatatgcaggatatctgatatgcaacccccgcaatgtggtcacaacccacagtttgagaaccagcttcggtagactctggaaccacacatttgaccttgtcctgcttccatggtctcaggaacttccggccgaatatctgagcctttacctcgcattggccgcctcacccaaattctccctctggatggcctgagcaggacaggtgtcctgtccttggaaagtcgcatccctcaggatccaactgaaagcctcagcagctctgtaaagtcttcaccgataacctcagagggcagagcaggaagcaatggtttgatgagctcagacgggtctgcccatgacatcagtgtctaggtatattgtgaaaggtcaccttggagtactggaccagcgcatatagaaggagcaggaggtctaggggaggagtccgggccctcggtccctcagacattaggtgtgtccacgttcagcaaggttttcttgtattttgcacaaaggcggcatacgggctaatatcaatggtgaagaattctgtggcagtatctccagctcataattgaagaaactggatcctagagaggccacttaggatgatagtggaggaataaaactgactctgaggccagggtcttgcctgaatcccacatctgtgttctctctggcacccattgtcttgcaccgtgagttctcttctctttaaccttagggtctacacatagggtttaaacctgggaggccatactctagcttgtgttgatttctatgtttctatcacagcaatgtccaatccgctgagctctgctgccatccatggtctttgactgtggttctagcagacagcctggtgtgctttagagatttccgttgctgtagtctaggaatgaggcaaaccgtcacgctttgaggtcgctgtcccttaaattatgagatgatctgtttcttgataatgcccaaacctccatgctaagctccttccttgacccctcccatacccattgcacgaagtacctccctttctgctgtgacaatgttccctaaagctgttatggttgatctacccaacagaatgatgtcatcgggcagtggcagcaaagtaaagaataaagcagatttcccagaaccctttttaacactgtataaggaggtttgggtcgcagccttgacactgtgtcctgtggtcatctccagagtttacacagtcacatggttggttgattggttgattaaccatgcatctgatttggttctcctaagtattgtctaaactgctgttagttctttttacaaaaggctgaccttttattatcttgccgtttttagtccagcttaaattattattcacaagtcccaaagcacacatactagttactattttctttttcaaaggtttgcatgtaaattatgaagctttcttgttcagaaaggttgtaagaaatgttgataaagaggggacattgccttacgtcttctaaatcctgtctaggaatgtgctgttcaattcagtgatgactgagttaccgttctgatgaaatgcagctgctcagagttcctgcccatgcaaatcgtcgtcacttcagtccccacagctcttcagctcaacgctgatttggcccacttgccattctaagccattagatgttttgtcccttgtaatttcccttaagtcccttaagtccttgctaaattggttctggcattgaggaattttttttttatcattgtccctcaagattcttcagattgcagccacctcaaggctgtaaaactgtagcagcatttcattccgagatgtctgtctcacacaaggctgtcctgaccaatttatgagttaaacagaaggaaggaaggaaggaaggaggaaggcagctctaattgtttcacactggtttatcatttaaattaataaaaaaagtgaaatactaaaaaccagaaagaccggtgactgggtaaatccgtggttagtggggctggtatggaatgatgtgccaaggagacagaaagccactttcatggaagagtgcttactgttgttacaactttgctttttattacaatttcactgtggcctcttgataaaaatgtccagcctccagggaaaaaaatccagcatgtctatttcagggacagtgtctctgttgtctgtgcctatgtggagctggttacaaatccaaattgggtttaaagtcgaatatttacaactcttctcagtctgacaaaatagaagagtgagttagtactgcctgagaattatttaccatcccgtgggtacttgtcagttaagagagagcattagtttcggctccaaactttgtctctgtaagtccttccatgggtgattgtttccaattctaaaaaggggcaaagtgtccacactttggtcttcattcttcttcagtttcatgtgttttgcaaattgtatcttatatctcgggtatactaagtttctgggctaatatccacttatcagtgagtacatatcatttgagttcctttatgattgctattggatggagcacagcacccccaatggaggagctagagaaagtatccaaggagctaaagagatctgcaaccctgtaggtgcaacaacattatgaactaaccagtaccctggagctcttgactctagctgcatatgtatcaaaagatggcctagtcggccatcactggaaaaagaggcccattggacatgcaaactttatatgccccagtacaggggaatgccagggccagaaaatgggaatgggtgggtagggaagtggggggagggtatgggggacttttgggatagcattctaaatgtaactaaggaaaatacgtaataataaaaaatatttacaaaaaaagagagaacattactgagagagagagagtgtgtgacgccccaggagatggagttcaagaccaacctggctgcctagctagacatcctggcttgttgagagtgagggaaccagagagatagagacgataaaattgttagtaaataagacagaggcactatttaatttattctgttcttacttgatttttaataaaagtgactgctactcacatgtaaagtcttacagctgaattaggcactcaaaaacaacatgtgttcatatttcagacagacatgaggaccttcctttggtgacttcattatagtctcaaagccaatctgttgttcccagtatcattaactgagtgtttgccttgcttgtagccacccttatttaaatgggtatctttgactccccctgaaaaaagacaacatttttgttttttgatttttttttttcaaaataaagcccctagttccacgcatgaaaatgtctgggctagtgcagaaatccccagcagaagatagtagccttcaaattagatggtattcccagttttctgacagagtgagactgggttgacgagtccccagacagagaggttagcctcctcagagtcccagccggtctttacaacgtggggaagaggcctttaacagataaactcgcccaaactgccaagtgctgttctttatatacattcctggctatcatatagtataaggtttcattgtctgactcaggagttaaattagatcaatagattatacgtctttaggaagatctgttaaagtgactgataaggtcacatgaatgtgtcaaacatccctctagcatgattctcacatagatatttccagtgcacaatagtggggaagccagtctatactagcaacacccagaaagtgcactgtccaagaacaaatgcgtaggcttggtgtttctattggtttggcttttatttttaaccaatcagtctcccctgtctaaccagaaaggcaaattgttgacactgaaacctagaatgcagcgcagtgcatggagctgtgttcctgtccgtggatgctggcagtcctcagctgaattaaacgtcatccacattgtgctgactcactaccgatctatctcttggtttttttccagataaagtgttatcttctcaaatccttgaaccactttaattggtttctttgcttttttattattacggttgagttgtgtgcgttctttgtatattctaggcactaacttatcacatacacaacctgcaaatgttttccccattcaatgggtgttttggtgggttttttaacttttgcttattttttattagatattttctttatttacatttcaaatgttattccctttcctagattcccctctgaaaataagcctatcccgttctgcctccccctgctcccgaacccacccactcccatttcctggccctggcattcccctatactagggaatagaaccttcacaggaccaaggacctcttctcccatttatgaccaactaggccatcctctgctacatatgaagctggagccatgagtcccaccatgtgttttctttggttggtttagtcccagggagctctgtctggggttactggttagttcgtattgttgttcctcctatagggctgcaaaccccttcagctccttgggtcctttctttagctccttcattggggaccctgtgctctgtccaatggatggctatgagcatccacttctgtatttgccaggcattgctgtttttatctttacacgtgtttttttgttgttgttgttttgttttgttttgttttgacatgcagttttagttgttctgttttttaattgtagacaaagtctagcagattgattctttattttttgttttttcactgttgctttggtaatagatagacaaagccacttgaattctgattggattcattttgtatggggcactaactagttaagggtctcagtttacagattcctaccatgtgatgaagaagaggttcttcctaactaaaagacattgtaccgtgtgcaaattctgttgactgtagacttctataccctcaatttcctgcctattcttcggtccatacttctacactactttgattactgtgactttgtggttaagctttgagattggcaggtatgggttctgtacttttggatttttttggtgatggtcattgttgttattgttttaagattgctttgaacattctagttacttttgaatttctacttcaattgtgatgtttttctcaggactgtttaagagaatatgggtttgtattttttttctcattgctaagacaagttatctgataagagcagttgaaagaggggagtcttagtcagggtttctattcctgcaaacatcatgaccaagaagcaagttggggaggaaagggtttattcagcttacacttccatactgctgttcatcaccaaggaagtcaggactggaactcaagcaggtcaggaagcaggagctgatgcagaagccatggagggatgttcattactggcttgcttcccctggcttgctcagcctgctctcttatagaaccaagactaccaggcaagggatggtcccacccacaaggggcctttcccccttgatcactaattgagaaaattccttgcagctggatctcatggaggcatttccccaactgaatgaagctcctttctctgtgataactccagcctatgtcaagttgacacaaaactagccagtacaattgaccccttgtcaacttgacacacaaacacatcactagtaagcctcaacccttagtttcttattcatccccaagatctaaataactttaaaagtcccacagtctttacatattaaaagttcaatccctttcagagatccagtatcttttaaaatccaaagactttttacaattaaaagtctcttaactgtgggctccactaaaaagcttccttcaagagggaaaaacatcagggcacagtcacaatcaaaaacaaaaattctgggatccactcatgatcttctgggctcttccaagggcttgggtcacttctccattcctttcctttgtagcacatggcttgtcttctaggctccagctgcctgtactccgctgctgctgctgttcttggtggtcatcttatggtactggcatctccaaaaacactgctgtcttccactgtaacttggcttcaacaatagcctcttataggctctcatggtaccaagcctcaactcctttgcatgaccccttcagtccggggccatcaattgcaactgaggttgcaccttcaccaatggccttccatggcctctcacagtgccgtgcctcagctgctctgcatgaccccttcatgccttcaaaaccagtaccacctgggtaactcttacacattaccaagtccagccacagcacaaggtacagccttggctatctctgcaacacagcctctgtggtctcagaaaacacttcccaggagatgtcacctcaatgatgctggtctcttcttaattaaagttaggttcttacctccagataaccagaatcaatagtcaatagttccagtaatgcaaaggttttgctttagtagttctgatatcttgttaatcacagctgattcttcagccccagctaaccagaaccacagaatcttcacaatcaaaatagcaatggccctgaaaagactctttaatcttccctctggaatttcacaagccaggcctccatcttctgcactgtactccacattatcttccaagctcctacacaacatctgacagagctcttaacaatgaatggatggatcttctagcccaaagttccaaaatccttccacagtcctcccaaaacatggtcaggtttttacaggagtatgccactgtgctggtaccaatttgtcttagtcagggtttctattcctgcacaaacatcatgaccaagaagcaagttggggaggaaagggtttattcagcttacacttccatactgctgttcatcaccaaggaagtcaggactggaactcaagcaggtcaggaagcaggagctgatgcagaggccatggagggatgttacttactggcttgcttcccctggcttgctcagcctgctctcttatagaaccaagactaccagcccagggatggtaccacccacaaggggcctttcccccttgatcactcattgagaaaatgccttgtagctggatctcgtggaggcatttccccaactgaaagctcctttctctgtgataactccagcctgtgtcaagttgacagaaaactagccagtacaaggggtttacttcaattcatatgtatgcattcatgatggctggaaagttcccaaggtagtgggagcacaaggcagctggcctcactgctatccccagttagttaggaagcagtgtcagacaatcgctggtgcccaccttgcattggcctttccattcctgtgaatattccagccctggaagaactgctctcacccacatgtaaggtgagccttaccatcccagttaactcaatctagaaacttccttataaacttatccaaagtttatctcctaggtcattctaggccctatcaagctgacaatactattcataattagattataatggctctctatatagatcagtttgggaattattgctgttatcacatttcccctattttcagtgtatgtgaatgtgtttgaggcacagtggcccacacgtgagtacatgcatttatacacacatgttgggtacacatgtggaggctggcagctgatgctgaccaacttttcccctccattctactccatttacagttgttgctgtagggctgccctctccaccccgctggtacttagatcctgggaattcaaactccattcacacttccagaaagccttgtgcactgaaccatctccccagactcctgttataaagttttaaataaggattaattaaacaacaggatgctacagcaggccgtgagaggattctagctgaggcccactgtgacaaggcaagttcttaaaattagtggaattcacgcttttggctttcacgctattattttagtaaaattccaaaggtttggtagtcctcttgtcaagatgtgctgtctctactacctcagtagcttctgtccgttttcacacagtcacttactttgcagtaaggagcatctctaccagatgggtgaggcttgaggcagcatctcccaccccaagctgctgattctcatgaagatgcggggagtcattttcccagctccccaactcttatgtgctgtagtttgaaacaaaacctaaagagaagccctagcaaaaactgagtagggtgtgaaagcagaccacagcggtggcaagatggtttcctggcacgaaacactgcaacagatgtgtcctgattccttttcttttctacagtcttgggaaaaaccaatgattttggacggtaacaagggctggttactctatttttcacaagcagctgccttcaaggttctttttttaaaagggaaaaaaaatgtagagatatttgccacccagaatatggaaatgaagccaaattaattttgaagtgtgcttccacaaggattaactggagatgagatgagcttgtttgcatgtgagtcagagttgggaacgaatgtaatttgcctcttgctgttcctctcagaaacaaattctgcaatgtagtcactgaggaagcctcattattctttattaatagctcttaggtagtgtgtcttgtgcagacactgttagctaggaaatcataaacagggagggtgtgtcaacagggctggagggatggctcagcacataatgctcttagagaggtcccaggagaggttcccagcacccatgttggactgcttacagcttctgtaacaccagctccaggcgatctaatgccctcttctggccatcacagccatgcacacacaagaacacacgtgagtgcactcacacacacacacacacacacacacacacacacatacacacacacaagacttaatattcttaattcatgggtcaacctgttgtgttttatgagagagagagaaagagagagagagagagagagagagagagagagagagagaagagagagagagagagagtttggtggaggcacagtatggtgtctgtggaagggggtggctctgtgggcccatgctgaggcatcccttccccctgaggtaccagccacagaaaggtatagtatagaataactttatgtgcctcagtacaggggaacgccagggccaagaaatgggaggggggagggtatgggggacttttgggatagcattggaaatgtaaatgaagaaaatacctaattaaaaaaaaagaatagagtttatttagggcattgggaggggagttgagacagagaaaggcagagaaatgggggagggaggagaggggannnnnnnnnnnnnnnnnnnncccacctccaaccacacagcataagatcgtaggggaggggagtggagggaaggcaggccatgagcacatggagaggtggggggagaggggcaagaggaatggggagagaggggtaagagggtaagggaacaagagcaagaggagaagagaagaaagtgaggaggggacaagcagtccctttcatagtgaatcaggcacacatggccattaccagggaactgtggggtggggcctagacgaaatgccaacacaaccaattaacctattctattatgagcgctgtccagagaaacagtattttgatatgtgtcaagacactattcattcagggtatgttagtatacaccaaaaaccttatcacttgggagactgaaagaggagcaacttgagttcatggctggccttgactctaccaggaaatcctatctccaaaagacaagggattaaaaacaagcaaacaaataaacaagtagtatttgcaatgcctttgttagtgggtagagtccagttcatttcagccactgctgatagatgatgtattagcaaagacaaagaatttactagccatttggtgcactgaactcgttgttgctgactggcatttgttcataaaggtgttagctacatcttttgcttgaaaaaaagcacctggcctctatgaaattaccctatctctgcctttgcttttggtctgtgtagcatttagatgtgtcttcccatcctgagacaaggctgtgtccctaagtctgcaatgtcccctattacactgaactctgtacggctgcgtaagtaggccagttgtgaaaccagacacatctttggcctaaacaagggaagcaagctgggtagaatttcattctggtacaaacactagcctgagcccttctagccctggcacaccagctgtgtctcctctttccgaggttgtaaccataagcggaagttttgcaggtgcctgggttcctcttgcagccttgcctcattaagaaggagcttccaagtacagtagtgcaaagttaagagtgtaaacgagagtgtagcacgttgataggatcatgcttacttgcattctataatgtttttatttaggaaacagtgaaagcaaaccaagtttcacattctgaaatagtgggtgtggaggcctctttgtttggtttgtttttttaatgtgtgtgactgtttgcctatgtgtgtgtgtgtgtgtctatcacatgtatgcctgatgcctgaggaggccagaagagtgccgaatcctttggaactgaggtgatggagggttgtgaactgccaaatgtatgttgagaactgagctctggtcctcttcaagatcactgagtactcaggaccaccgaagcttctctcgggccccatacatgtttcctaatgaaagtctgtgatttaaaattcaaagttaattgttagctttaaatatagcaaccttcatttcataattactgagtcttaggaagcaactgagagttctcagataatagccaatatcttctctataaaggaaggttgctacacatacttgtcctgtgatataggcatcctgtggcatgaaaatgaatcattgtgtcatctttctttgttacaataaaacttccctaggaactctagccaaatgaagtgcttattgctagaaattgtcaaagataccaataaacagttctccagagtttctatttgtgaaatgtagtagttgctagtatagttttaagtgtagttttctaatagtaaatatctgttgcctaatacaaagaaagtttagtgttgccactgaggtagatgagtgacagttttcagacattattattatctgaaaataatctttgatgatttaggtatatacattttacattatatatatgcatatatatatacacacatgtatataatgcatatgtatatatacatatatatgcacatatatacacattattatacttttatatgactttcaaaaaataagatgtaggaaggctgggtgtgacttacttacttacataggagagtgcttcatagcctgtatgaagcctaggtttcctcctcccacattgcacaaaacgtggtatgatggtgtaatacctgcaatctcagcacacaggtgatgaagacagacaaatctaagaccttggctacttagtacagctaggcatgaaacactgtctttaaaaaaaatgtctatccatgtacatacaccgctatcatttgccactgtgagtaacaagaagatccaagaactaagcaaggatattcagcatcagtgaattgtttgttaaatacctacaatactctgggactgttaaagattcggggcacagtctttcttactcaaataacttagaataatttagaatttgcttagagaccgcagatcatcagccaagacaaggctctgttctcaccgaggcagttgatgaaggctgatctgatagcacgaggtggtcttgtctaataaccacccttcctcctaaccacctcaagaagactactaagcaagagggaagcttgcttttcaacggctcaagccacgttattttataggttcaactaaggccatacatcacatgtggtcaataatctaaggccatacctaacgcctggtcaatagcctgcagactaacccgttccattggtcttgatccaacggcactcacttagtgataatagcaaactcaaggctgaatctgggaataatatgggcagcttcagcgtcctttcactgaacgtgttacgcactgaagagttgtctcaacagctttgcacacatacatctctgttgatgtgttaaacattttgtaggacttgggggccatgccacctttctccatttgatcggaactcatatgctgaagtatgagtcgctgacagttccgtggaccatgatatcataattccccatgatgacttcaccattgattctccgggaccagccatgcaggctagggctttgccaatgtttatggtcagagacttctggcaaacagcatggaagtggtgtattgttgctggccattaaatcagacccatgaagtggcctcccctgccagcagagcagatcgcttcttgattgtggaagcatggtttgttttttttccactcaaatttacaaagaaaggctaacaaataatttaatgaaaagctctgtatatgtttttgtttctattattgttatcttcattttgatcacaaacttttttttagtctccctaagtcttgcttaatcctcaaaaaaatccttgataagcaaagtgtatggcttttcccgtcatttattacggtattactttatatgttttggaaacaggcctgtgtatgccaggctgctctcattcgcagtccccctggttcagcatctcaggtgctaaggaacatggtagtcgtcttcctttcttctcttgctgagtctgacattgcaggcaagctgacgtcctgctctcagccctggatacactggcatatgttctgcttatgtctacagtgttgactttttcaggtcgaatatgcatttgtatctcttcacaaaaaaatatgcccacagccaagggatgattaatagaaacagttctcatcatgtggctttggaccggcaacagcagcatcaatgagaaattgttagaagtgtgcattccttggcctcattcccagcctaataatccagctatgtgtggaatagatgtgtcagcttttatctctgtggctaaatacctaacataaataaacttaaaagaccagctttattttataatatatctatatttcagaagtctgagtctatagtccattggccctattgctttgggtttgtggcaactatattatggccagaagagcttcttagtttccggtgaccagaaggagaaagtaaagatgggaagaagaagaactgaaacaagagaattctctgtaaagacaaatccctaacttccaagaggtcccatctcttaaagatcctgctgccactcattaccaacttgggctgcagacaagtcccttaaaacatggacctttggaggaaatgtaagatctagaagtaattggtgctcagtctgtagtgatagtgctcagttagtactaaagttatgatgctcagtctatagtgatagtgctcagttactattataataatgatgctcaatctacagtgatagtgcttagttagtattacaatgatgatgctcagtctacagtgatagtacttagtattatagtaatgatactcagactacagtgattgtacttagtattatagtaatgatattcagcctacagtgatagtgcacagtctagactatgttaatggtccaaggtccagatatagtaatggatgtaaatgatacacagcttgtcttcagagagagatgtttttgctattgttagatcttttttaggggaggtggattgggaaaatgactcagtaggtaaatcacaggctgcccaagcttgaagacctgagtttgaatctctctcccctcccatgtaaaaatggacatagcatcatctgtagtccctatactcctacaggaagatgggaggcagacacaaaaacctggaagctcacagcatgagcaataaacaagagaccctgtctcaaacaggttggaaagcagagactggagactgacaactgaggctgtcctgggacctccacctacacaccaagttgtataaatgcctgtactcacatacaagcacatgtacatacatcatacatactaatactctctcttgagtgatgttgcctgtaaaactatagagctgtaaaggatggaagatattcaaagactcgggttctctctctcagacccccctttaggctgcctaccccagtgtccttagactttagaacaaccgcagtacaaggtgttggctgtgaatactaaagttcaggaactaccggtggaaatggttgggcctaagtgaactatgagtgtgagatgatctgctttcttcctccaggatattacacgtgctcgtgtgagcttagagctcttaatttgtatgtaactgggtaaagggagaggactatttcctaatgtgctacctaccatcttcccctcggatttattagagtaggtgatgccagataaaatgggttcaaccaattctttgagtttctgtttgtttctctgtactttgtccggaatcttttatccaaagtccttgggattggaaatgtttcagatttcagaatttttcaaattcggggcacaacgctaccagttataactagctatcatcttcagtccaaagagctgagattcggaatgctttgaaagctttagctttcagaacatcccacatgtagagtctgagagcaagcccatgcaatataggtattcagaatatatcagagagcaacagtaaccctcacgtttactactgaagaccaacctgagccgtttccagtctgctgctggcaatgtctgtgatcctgagcaaaatgggagaaagctgtctcaagaaaaagaggtggaagccaagggaagggctttgtaatgtgttcaggcctataggagtgcggttagcgctgagcctgtgtttacattccctcgttcccttaggcagggagccagtgtcttgcactgagtgttttgttttctcccaccttaaggagaagccttcttatacctaaagcagaaagtacctccttcaggtgcaggagggaaaacttaagcaatctgtggattgctcaaaacacagtctgtcctttgataaaccaggcatcgccctgcaagtcaaacattgtatgaaaatgtgagaggtttggcagactgttctctttgatgtggagagagaaaagctggcttcctttcccacattcagctcgggtctgcatctaccctgctgctaagaggctcttcaagggaacttgaaagtggtgccggaccctccagctttgcagattaaggatctagggtgattaactgatttgatcaaaatcagagactaaaactggtcaggggtcgagggcttcttcacatcttgccagagttcttcagaaatcaaagtgagttttaaatacctggggtgtgaataaatgagacaattttcttccattaaagaaaagtggccacgaggaatggggaaccctttgtagacatcagagtgttcaaatatggccttgtgtccaacacggccttgtgtccaacacagccttgtgcccggagcttgccacgagttgaagcgagcatctaagctggcaggttccggtccctcgggagttcatcctgtcatttctgcatgtctgtcccttactccgctgacagtaaacagtgtctacatttttcaggatcttacttcagttgctgtaaatacttcaacaatctgaaagtctcattcagaagccacttaggaagaaaagttactctcagtggaaattggtatcctggaagtcactgtgtctcaatgcatacttgggaccaagtaaagtataatgtggaggagttcttgtttaaaataccgggtcttgaactcttcctcacactcagagaaatcaactcatcttctacttcaaatgattcttgaataattcaaaaggtttaatgtttatatgtgctagtaaaaatacaagcttttgtagaaaattgagagtgtatttgtatatatctttgacctaaaaaattaaacattattaatgtatcctacatgaagttagaccagtctttcccttcagtctctgatttacagtgttctgacttacaagattttctgacattgtagcgaggagaaagtaatgtgttttgaatcataatccgtccccgggtcactacatgtggtgccagcatacagcactgcgtggcaggtccttatcttagtcagggttaccactgtgctcaaacaccatggccaaagcagcttggggaggaaagggtttgtttgatctacacctccacttcactatttatcgtcaaaggaagtcgggacaggaactcaaaaagaggtaggagctgatgtggcggccttggagtggtgttgcttactggcctgctttcttatagaacccagaatcacctgcccagggagggccccaccccacccccatcaatcactaattaagaaaatctcccacatacaggcatgtgtgcaacctaatcttgtggaggcattttctcagctgagtttccctcctctctggtgactttagcttgtgtcaagtttcacatgatcaagataataatcaacaatagccctcactctctcatcttgagctctgctgttcagtggactaggtgcagccgtggcatgtttgactaggaatgttgtgtggaaggaccatgaggctatattcgcatcatgaaagaacacatgtatttccaaggggccactgcataaaatacttccgggagatgacatttactttgaaggttgaatacagctctgttaagtaacacaatgttgaggttgcgcttaacttacccaagtcactggcataaactccttttctctttgtttttattgtgttcatgtgtgggcacacgcacatgtctaggccagaggacagcaaaaggttttgttccttagctctttacaccatctgtttgaggcaaggtctctctttggtctgcaagtcacccaaatggactagactgattagccaggagccccaaagatcctcctgtctccattctgaaattataaacccaacaccacacacagctatctccctgtctccctcttccccctctgtgttttggggggcaggacaggttatatccatacaactcagatcctgtgtgtgtgtgtatgtgtgtgtgtgtgtgtgtgtgtgtgtgtgtgtgtgtgtgtgagtgtgtgtgtgtctgtgtgtgtctgtgtctgtgtgtgtgtgtctgtgtgtctgtgtgttctgaccacaaaactcaggtccttacctcctgacccacgcacaccccccaaacccgccaacttaaccacttattaacctcagtcactgctcttgacagtgaacagtgaaagcctggggctggtgggaacttcttgcctagatgctgctttccttggaagttcagagcctgctcgtctctctgacagatccttttcctctctcagtcctgacccttcgctctcctatcactgattccaccatagaaatactccatggaggtggccttcaaatccaagatgatactaacttcatcagaggcaaaagagaagattaatgctatgcccagggtgaccagcattgtagaggacattcatccgaatctcggacagttcactgacagcctagcatccgctcaggaagtatgtgtccgatagtgaacggacaaaacaagaacacgagaaaagctatgctggctgccaacactagatgccagtccccaggagggagctcactgtgtcacacggtcacatgtgtatattttagattacataggaaaaccctctaaaccccttttgtggtttcctgaagtgacatggactagaaatcaaataccagctcttcttttattccacaaacaaatagaccacctgattggacatgctccagaaatgtgggaaagctatcattggctattttccttcaacctgtggtgaacaaggcatgtggaaatagaatgcttaagaagagagcaataaaaattaaaatcatttccttgtcttctctgtgaaggggatgtacgatcatttctccctgtttagatatccaggcacatgcctgtaatctcaatggttcccaagttcaaaggcaggctagctacatagtgagtcccagaccagcctgggctacatattaagactctgtctcaaaggaaatgaaacaaaaagaagtatgtttttcaaagcctttttcttgcgtatccagagtgagcaggattaatttaccctcagcctgcagctgtcacctttcttgaacacagagaagaaaggaaacagaatcccttagagaagacatttagatctcttccttttgcctcagtctggctagaaaggtgcagtagtgacctgggttagagttctgttcccatttgccctctccagactctgtgtataaaattgatagtgcgtacacatcacacacacacacacacacacacacacacacacacacacaccacctgttacctcataagcgatagtttattctgaagccaaatgcgtctggcagtggcctgaaacacagatttattttctccaaattccatgttcctacatggaagcatcttatagtaaccaaacaaagaaagccataagtcaagacactccgtaaaggcatcggtggaaatatcagggtagactggttgaggaagagcagagaaaccccacctgtagtcctcaggtgccacctgatgacattctaagcttgctgactggttggctaactctagtttgtacatccggagggatttacctaatggtcgaaaaggagctgcgtcaggtataaaggagaacagtacatgactgctgcaggggctattgagggcccaaagctctacacttgctgccttccagagtttctggtctctgtggttctcatcagttacatgggcttacagaagggtcagtggaactttccagaatccccaagtgtatgtgttaattgccttgaggtgcagtctttgggtggcagttaggattgggttccgtgtagctaagatcttcatatagaagcttgccgtggacactctgctctgtgatggcccagtgggagatcccttgctacatacgggtaccctgctctctcttttttttatgtattagaaagagaaggatttgtatggcttttgcttcttttgttttgttttgttttgttttgtacactgagaagaaagcagtagacagaaacagaagaagcccctgcagaaaccccctttataaattattcattctctgatcctcagttatgacagaaaatagaacagcctcaagcttagggtaatggcgcaaacttatgatttcagccactcagcatactgaaacaggaagatcctgggttctgggcagacctgggctacattgtgagatcctgtctcaagaaaatacagtggtttgaatagcttaaaaatgaaagtgacttttctcatgttttttggagctcgtaaattcaagatgatgggtatttaggaaggccttctcagtttctccatgatacaatttgtttcatcgtattgggagcaaggatccagatgttctagaggctgcccctggggagttcctgctatgctggaacaaagaactggcccagggacacgtggacagtggtagaaaaagacatgatttattaagaaaaagaaagccattttcaggatggaactttgagagatttggacacaggtgggccacagttcaaaacactaacggtcctgggttcttgagcctttttagatcatgtgtgtagcacccaccttcccccatcttaggagatcacagaggttttctgtgtgtgcatgctgtttggtcacatacagccacaggaagtggaggttgtcttcctgccatcggttgctttcctgtgctgatcttgatgtttcttcccataaaacctgtcttggaaggagcaatctctctggtttctccccagcctcagcatccagtcaccctgggataatatttagcgtcagtcttcaccttaaatggctcttctcaagatgatgcccttgagggctaaggcctccatggatttcatcggggatccagttcagcccacaccacttagctgggtcagtcctttggctaggtctaatgtcctccctctctgttgacccttaccctttagccacttacagcgcatgtgctctttattctaaaagctatacacagaagccatgacatatagtagtactcttaatttttaattttttgacatcttgaattggaatagaattacatcaattctccaacccctctcagcatccctccctcaatccccttctatgctaccccagtcttaggttggtagtctcctcttcaaatccaaaataaatactctggccaccattttttttatgttatgaagcctgagagtcacaaacaacccagcactgctcgctaatcgtgcactccatggcccaatctagtcatcctataaaaacaacagcatgaccttcgggctttttgaagatagttttgtgcagacccagtttgtccagtgtgagccctaagttgaaatcatcaggctaaattgcacggcttcctccagctgtcccggcttctctaaatggagtccctgggcttgagtgcagactgcagttctcctgcctctgtgatggtggtgtcatcactctgagtgcagtaagatctaaaactcgcctggtatttgccacatgtcttggtgccaggcacaactcagcttctccggctccccaggaaggaagtgacatagccgctgtgtacgaggtgcttgaatgaggctactccattttcctgctgacttgaagaatctgcagacacttcccccaaatactcccatgtttaaatcaaacagctacatgtcttgaatcttcaccctacacgtgaaaaaaaaaaagattaatttccatattacgaaactgtaaaaggttttaagcgcctttccttcctgtgaggctgataaaggagtgaatttgtaaactgcggctgggttaattagccagggttaattaatgtttaccacactgggacgatgaaaagaggtgtgtaaatgcacagtaatgcgggtcatttttcaatttattgttgaagcttacggtgtgtgtgagtgaggacaacataaagcgcatgcgtgtttcagagggctactgatgctctgcggtaattatgaggcgtaggcttctaagtggattaattacatgttcctgaagacgatcacaggctaatagtgtttatttagggacaggctgctgtttcaagttgaactatttggagagctgggtgaggtgaggagaggctaactgtgtgggcatgaaaacagcattttaaagtaacctttaaaaataaataatagatagatttctagagtcgtgtattttcaagagagcccaaagagtcttaggtgaagtcctggattaaagctgggaagtacagatactagaagcagtttgaagagattggaatataatctcctatgaactgggtagatatccctcagtgttgggagtttaggaccagattccaggacacgcccacctcaggaatccccaaattcatggatgctccaactccttatatagacagtttgtatttgtataggacttatgagcatcttcttgggggctggagtgatggctcagtggttcagagcactgactactcttccagaggtcctgagttcagatcccagcaagtacatggtggctcacaaccatctgcaatgagatctgatgccctcttctgatgtgtctgaagacagctacagtgtacttcctgagcatcttcttgtgtgctgctcataaaacctaatccattgccactgctcagtcaacactcactaccctgtaatgttttgaaaacagcatggtaaaagccctatttgtgttcaatacagacacagtgagtgttttcccattaacttttgatctgagtgccggagagttggcttagtggataaagtctttgctatgaacacgtgaagacctgcgttctgatccccagggccgtgtcaaaagcaggaatgacagcatgcacctataatccgggccctaaatgatggaaagagaagtgtctgaggaataggacatcctagtgcttgtgtgggtcctttcctgtcagccttgagttctttgcatgcgaagaaattgagttagttatttctggcactggtctggaaatatcatcgacaaatgagtatcagtgagctcaccacgtaactcgtttgagtctccttgttccagattcttacagggatttcttcccactcctcacctctgtgcactgagtgccttcctgaaggcaggtcgattccacccctggccaaacccctaacgcttagcacttgccatttccaggcttggatgctatcttactttttctgttgctgagataaagtaccctgaccaaagcagcttaagggagaaaggctctatctccgcttgcagtccaaggacacaatggatcaaagcagagcagccaaagctgcaggtcacttgacatccaggacgaggaagtggagggtggtgattggtcggttcttgttaatttccctctttggcctagtaggacccaagcagagaaaggtgtgacccacatttagggtaggtctaccttctgttaacctaatgaaaccgatccctcctaggcaggcatggaggctaacttaatctaaataatcctttgtctccttggttactccagagcctatcaagttgccagttggcgttattcttcatcacagtctcctgggcctcgttaagggaccatgtgaatgagtttctgctggagagaaagggccatcgccatagctaggaaagcaagatttcgttaaagacaaacaggccagtgtacagaagagcatactggatgtgtttagggtttctaaaatatgcatacattagcatttaaatgagcggtcatgcctacagagatgtattgtgtataaggaacatagccctccattgtgatgacctgtgtatttaggcacattttccacactgagcccttatttatcagcatatcttttagggtctccccatgaaattgtctacagatgttggcatcttcctttctaccacgagctcaccatcttttgacccagttttttcatccccctgaatatagtagttgtccgtccctcatcaactggaactgtactgagctctcttcctggcccagcagtgtgtgattcccattccatacatctgctgtggtcttgagcaggccaggcagggttctcttccaagtctgagggagagcacttgagagcctgggccactgcatagctacagttgtataagtcgcacaggaccctgctataacggacagcagtcatggaaaccacagtgaagagttgtctgcagctgcacagccatgaacagcagtcctgtggccatgccagcatggccacccgcccctgcttctctctctgatgtgtttgaagacgcacaccattgctgaagtccaaagcacgtgtggcagagccagtcatgggctgtgcatgtgactcactcgcctcaaagaaaatgttatgtccatttgtaaggagagaggttgatttccttaccagctgtctcagaggtggctcggagctcaagtggggatgaaagaaccccaagtaatgatgcccagaacaccctacaggagccgagaaggagccacgggactccgggctcaattaattttttttttcatctcttactctacgtttgtttttttattggtccacactaaaaattagtttttcataataatagatggtgctattataaatattctgaccttttacttttaagcaaatatacgtcaacaccaagtattccaaagagccccagtaaaatgaaaattaaggatctaactggaaagatttcttccccataagtccatatttatatgtccccaaacctaatagtagtctcaaagatgtcattctctatggccacagccataaagattaaataagaaaacaagacgggacatcctcttggagttgggggaggaggtatgggatgaggaacagtcagagggtggactgggaggggagctaatgactggactgtaaaaaaagattcaataataataatgatgatgataataataataaataagtagataaaataatttctaaaagacaaaaatgaaaaataaaaatgtgagttaaatgtatagtggcctcctagtgctagattttccaccgtgtgattcattttccaagcaagtacatccgtgtaatttacacgtatgagcattagaacttcagcccacagaactttctttcaaagaccagtgctgtagtgtgaaaactctgcagtcagggccccaggtggctgacatcccagggggattaagaccccctaaagtggttggaaataagatcgggaccttggcccaagttccataaataaacacggaaagggaagctttttaatccttttgccaaggccagggagcctggctgtgttttcatcttgatttctggctaatgccggttgatagaacggagctgtttgatgtaggagtttgaaagccacaaggaaactcctcttcaagggaaaggcacttcttctgaaacttcagtctagaccagacgatggtatttcaggaaaatgtcacttgcaataaggagtagttttcacaagtgatgctccgccttctgtgagtcctctctggggacagttgcctaccataagtggacggaacacacccccatttgaaactctgtggccaggaaacttctacacaaaaataaacctcgatctagacatgagtctgtacttagactctgggcaattctcgagattgatagtgtagctccagataaaagagctgccttaattttctagacgcggaggtttgtggggagagctcattgctaagtgatgtctatagaggttttccccccagtttgggaaacagtcctacaatgatcattctctctcagccactgaggtaacctgatcactccacttcatttgggcacagaaaagatttgtggggcagagcccaactcaaattcagattgtttaacttctcttaactgtgaagtagggtgttgaagcctagtgggggttcctatggcaaccaaacagcctcctcttagattggttacttttctccttgcagagacaacatctgacaagaaccaatttgaaggaggaagggatggggtttggcttgcagtttaaggggagatagcatgcctggtggcaggaggcaactgttcacatagcatccaaagtcaggaagtcaggagagggaacaggaagtaggactgggctgttaagtgttcaaggcccaccctcagggactgacttccttcttctgtgaggcttcacctccaagagtcagcaaactgactcttccctgagagcaccagcatcgatgagctaagtgttcaggtccatgaggctgtgcgggatcatccacgttgatatggcagttcccacagtatttcatgagatggacattgaagaagggaaagacagtgagtgttcctgggggaaagaaaccattgttggaaatggaaaatccaaacagaactgatggacaacagcttcaggctctgtcacacttccctaatgagcctctagagctacacctttaacctctttggcctaagtttattgggggggggggaataataatcattgaaattatctctttctaaataacatgaaaattctcatgggctgatgagaggattacattaggaactggggtcctcaggtttcagttatagtatcagttctgctactcaatatgtatttatctacatattatttatttttgaggcatattctcactccatatgtagtgctgtcttggaactcactacatatccaagctggcatcgaacttatagccctccagtttcagcctcccaagtgctagtattgcaagtgtggggctagcacatgccttgtttgttgattttaaaccttctgagaatggatgtttgtgcattctgttctcagtgggggttgctatgggtaccaaatgagccagtgagtagctacaaaggccactgatgtggacagtgtagggagggtagtgggcccccccccagcccccaaggtatagcaggacttgagtacttggtggactggtcatggcattggagatagctgtggtttgtacgtagtcagagtgaatacagcaaccataggaagattccatgtgtccctgcaagtcagcatctctattagctgctgcctcacaaagccaagccaggtctgtccagccaggctggtctgcgaagtgtccacagtgcagaagtatctctcctttctgggaggagccaggaatgacgtgtggcctggtgctttcttgtgtgtacgttcttattcttggagactaagaaacatcaacctattcccaacacatctctgtgcttccccttcctgcttaataaatgatttggccaagaaggaaatcatggttgttttcagttttcctgggctatcctggtacagaaatgtgatcttgaacgttagttttaaggcagccaagtgttgggtttgaaaactaagatttgctgaaggcgtcctccagcgcacgtcttctcctggcagtggtggtgcttagctgagtgtgacacactctccgaaaactggtctgtctgtgatgacgggaactgaggtcactacattcttgcttctgcactgcatggcttatggctccggtcctctcagacttcaccacaagtgatgactagcctttgacagttgtcacctgggagccctctaatatgcagatttgctacctgtatccaaggagtggaaggggcacgaggattctgtcttttctctttctgagacaaaagtttgctatgtaacctaggagatcctcaaacctcctatataccctaggtaagccctatacttgaaatcctcctgtctcagcctcccaagtgctggaattataagcatgctttaggacacctgtaggacaattctgtacttccaacaagatccccaatggacacctatgtcccgagattgagtttacataacagaatttaagtgatggagtgccagagactgtcacccaacctggaatcttgtagataaggaatacaggcttaaggagtttcagaggccacggggacattaataacagcatcacattaatagactgagccaggggttagacatgcacaggctctggttggaaaattaaatctgatctcatagctctagtatgggcaaaatgcctagaatggatgatggctgatttctagtcaagctctttgatggggaaaaattacagaccttcttccagtgcacttggagccaaaggacagtgtagggaagtagcaggcagatatataagtatctatttaaaacattaaaatcggttttaggagaatcctctgttaaacaaaattaaaaagaaactcccattttggtggagatcagagatcagtaatttttcacagggagacaaagaatcaaaattaagacaggtataatgtcaataaagattcagtcctagaagaaaaacagagcaagcctgacaaaccgctggttcagtggtctaaactagccctttaatagccttgtttgacaaggttaagataactcctcacttgtatgaaaaataaaaaataaaaaatactcagtatgtccagtacacagaaggcatcagtctgtaattaccagttattatgaaacttgttagaaagattgactcaatgactataaattttattttttagaaacctgaaatgtagcccttaagattttgaaatttatttggctgatgtgtcatttaatagttataaggagactctgggatggaatacgtaggattcgtgtcttccctcctctggcagacctttattcatgaggccctttcgctaaaaacaaatggccatggacatctttagtgtccaccaaaccaaaactaaaagtttgaaatcatttgaagatgaaatcactgtgactctctcttaatgttgctctctttgaagtatcttgaatgttttccacaatagctaacgccctcccctaccccaccttcctgtttactctaagtttgatttgcccacataaatcatcaaagcgtttttgaaagaggaaagtgatggggttcactctgtgtgtgtgtgtgtgtgtgtgtgtgtgtgtgtgtgtgtgtgtgtgctagaattcacacccattatgtaaaccataagtgaaacattaccatcactgggcttaattaaatattcctgctttaaccttgaaaaacccaagtgtctggatattacagaagattcttgactggagtagtacctgatgaaatgttagatggtaacaaggtgctgtcctgaaggggaaaagggagtcttgggaaaatgaatgttgtctcttagattaatatagcaattggtaagcttggatatttaaaggcttcgatggtccttaatataggccatcaaattagaataaaatattaaattaattcaaataaaagtataacccatttgagccaccacgaacacagtagaagatggtttctggtggctttgcctcaccatgggatcaaagctcagtgacacagtcactctggtccctgccttgtcggacacaggcacaattgcccagcgtcagtgcatttcccagcggtaaaatcctgagcccttaatcacagagtagctggctgtcttgaacattttatgatcataaagtagagtcctaccgtggtaatggcaatcctttcgaatttattcagctctctgcccttaagagcagactgaattccttgttctaaatggcattgccacaagtggttatttttaaattccctacgttaaattaagataataatatggatccctgctacttgtgctaagagatttttctctcagctgaaaatgtcgcttttcttgaagatttcaacttttcacataaatttcctaatagttttttttttgttcgttttgaggtgatgcagatgatttttttaaatgtgtaagaatgttttgcctgcatctatgtattggcactacatatgtgcccactatatgtttcagaaggtatctgatgccctggaactagatttgtagatggttgtgagctaccatgtaggggctggcaactccacccaggtcctgtgcaagagcaaccagtgctcttaactactgagccgtcaccacagctccgtccccatcgtgtgaatttgtgtgctgttcacagcagtgggctatgtgtcttgtgtctatttggaggaaatatcttgccaacaactttaaggataaatgagacaagggtgccacgttgtctttgcctgaactttccgggaccctgtatgcaaatgtatccaaatataagatcttcctatgagacggacatgtggtctggtctgcgctctctctctctctctctctctctctctctctctctctctctctctctctctctctctctctccacctgctctagtctgagaaaccccttttggggtgggagtgggcagtggtgggaggcaatgtccactctataaggctggtatggttacaaatcaacctctccagatgcaaggcttatgtttgatctgctccgcaaataagcactcccaggatggtaacccacactgttcaataccacagctccagagggatgctggagacgggaaggagttgcaacccacaaggctggagatatgcagggagctagggacactgaagggccctagcatcttggattaattcactacacagtggagactattgaaatgagaaggagtcttgcctcagtatctgggaaggatctagggaaggcagtcaaatgcagattggtaaagagcagcgatcagtcagttcatattgccttaacaatatctgagctcgatgcggtggtacattcctgtaatcttagaactgggcagtgggggattatgggttcaaggttatcctcagctacatagagtttgaggattccatgagatatgagactcatgtcttcaagtaaaacaataacaacaaaaaccaacaaccagcaatttatcacatttatataaatttataactaggcaatttataaaaaataagacttttgtttctcgcagacctaactacaagtttaagaagatgctggaagcttcagtgtcttagagaactcaactttcctcattcagagtggggacttgttgtgccctccagagaggacaagccctactccattaatagcagtgagagccttcacttaatcccatccccaaaccccacacaaccctgtgtattgttacttctccggggagtaagtttcaatacgtgaattttgaggcatattcatatggtagcaggcagtaagtccacagctacacttcatcaaagcaaaactgaggggaggtcacagaacagggagacgattcagaagcggacattcgaatgttgtcagtattgttaagtatgtatcgtggatagttctgaggctgagaatgtatcgacgctaactgccacgggaaggcaggagcgaagagaaccaagtctgtagtccaagaggaaggctcaagcatcatataccttccacgttgtcagaataaaagagtcagtcatgaagaaataccatttcaatgctgtccacatgaaggagatctttacaccttcaagcatgggtcattttcaaaggagaaagttggagaaggaaatgtgagaagaaaaggttaagggcacagagcttgcttattttttctccttccttcctcccgtccttcctttctctcttcctaaggaccggctgacattttcagacattatgagggaacagcaagacaatgaaaaagtttcaaagtccaggaaaagcgtggtaataaatgccatagagacctcaggcatccaagagctccctcctggttcttgcctctcaaggtggacgtgtgggcatcgataattattccaaactatcttgacttcagggtattaagtgctaaccagtcaaagcataagatttatataaaagaaatgcccacttaatttattaaatcagactttggccaagttactggccattacctgtgacttgataagacatgaaaaagtctaggagaagtctaatgagggccttttatctgtgtgggaaaggtcattgcaagcatcaaatattgaattttagatcagtgccacactgagtaggtatatattataactcaaattagacttcaaaaggactaatttgctaggggttctatcatttaaaataatctcttgtaataaaactgactctacaggaagatattaatcgcatactttaatgctgtcccttcaaattgttttaatgggtacacatttgagcggaatattaatttttccagtaaattggcttttttgtcaacttaaaagaggattgaaaggatgatagtaaaatgttacaagtcaagtataaatccaggtttaattttctttattttctccagcattgatattaactagtgatgggcttgaaatataattcagtaaactgacacaggcgtgactcagtaatgacacacttaattaatcaagtattaataccatatgatcaatgggcctctgatttttaaaaaactatagataaaatgtcaggggaactttttgtaagataataggagattcacaaatcatctgttttggggggttttggtgatggtggtagcaactacactcattatattacattctgtttttctgttcccctggtaaacttttttaataatgaaaggtgcaattggaggatttcttactggactctcagatctttgggtagatcagctatattccataaggttgattttttttttccttcggggaagatagaagctacagaaaacaaattcagggactttcatctcaggtcacttatatgatcctgagaggaagagataggagattagctcagacagtgagcattcttcagggtcctcagtgacatgccttgaaggacaaagtgtatgtttgtagctctgctgcatctggggaaggcagctgttttcagagcaaaggtcacggtgactgaatggagcaggaggcccgtttgtaatattttctcacccatccacatctgcccggaggtgggggtagacagacgctatatcttggttcccagactgcacctccatgcctgctgttaacactctaccccggtcccacatcatagcatgctgtagaatccttcatgatcactggatacatggggagtctgtggaaaggaaaaggcagttagttcaccctccaggtcttcacctctggagaagagaatcagcaacaagatcagccagtctcgacaggctcagagcagtctcgacaggctcagagcagtctccacaggctcagagcagtctccacaggctcagagcagtctccacaggctcagagcagtctccacaggctcagagcagtctccacaggctcagagcagcccatcgggtcaaccactaagctctgactttccttaaggtgcttcgttttttacatgttaggtggtgccaagtgacacctcgtcacacacggcatgtagtcagtaggaatggccgctgtaagcgtacgctaaccgaggacacactggcttttctttagatgagctgcttcagaaggagcagaactactccgacgatgtcttggccaacatgatcagtgagcccagaatcagctacggaaacgacgctctcatgccttcgctgacggaaaccaagaccaccgtggagctccttcccgtgaatggggaattcagcctggatgacctccagccgtggcacccttttggggtggactctgtgccagccaataccgaaaatgaaggtaagagtccctacctggagccaaaagccttctgggtgggtgtggcctatgttataggtccccatggtaacagttgcctagagtacttttgagagaaggacctggtgtgtggcagagatctgtgtcacccgcagggataccactcctatagattagaggactcacagtatatgctgtgattgccccatgtgccgtcttcatctctacattttaaaaaaggtaacaaaaataaactagtactttttatttctcctttccctttgtaaatttacatacatatttacatagagagaggcacacacctaccaactgtccaagactggcatgtacaatatagggaaacaccatctcaaaataaaagtgcataaggaaacatagatcaggtcatggatgactgtggaggtggggggcggggtggcagagagaaggacagacagagacacagaactagagacgcacatctttggactcccagaaatccacctgcctcctcctatgtttgggaatttaagacactgggaaataattatttaaacatactctcactgggagttattttatctcttccatgaaaccaggatttgatttgcgcttctaagcttttggcccagaatgtccacctttaatgaaaagggtgaccaaattaagggcagaacttggtcccccagagagaaggtttgacagggccttgtacagtagacagacgctgaaataatcctcctcagccgccgattcttactgaaagaatgcagcgaacgcaatagaatgagtagagtgaatgaagcaagtttacgtcagaactaaagagaaatgatttctcgatcaacgaatctgcacacctgggtgatgtaattctttcaggggggattatgttagggcttctattcctgcacaaaataccataaccaaaaagcaagttggggaggaaagggtttgttcagcttacacttccacattgctgttcatcaccaaaggatgcaggacttgaactcatacagggcaggaacttggagacaggagctgatgcagaggccatggaggatgctgcttactggcttgcttcccctggcttgctcagcttgctttcttatagaagccaagactaccagcccagggatggcaccacccacagtgggccctccgagccttaatcactaattgagaaaataccttatggatttcatggaggcatttcctcaagggaggcgcctttctctgtgataactccagcttgtgtcaagttgacacacaaaaccagccagtacagggacttagaagaacctgtttaggaagcaacaaaataacctgttagcttattttgccatttttccatgttcagtacaaattgcatgcacacaattaccttgatttcttgaagctaagaatgctttccaagaaggcaacagtatctgcctggggttttcctcacagtgcaaaagcactgagcaaacagggtgatggttgtgtttggttggtttttggtttgtttgtttgattttggttttggggtctttgtttgttttttgaggcaatatctgtctatgtaggtctggctatcctggaactcacttgtagtccaggctggccccaaactcacagagttctacctgcctctgctgggattaaaggtgagttgccaccatgccccgtgagtgagcagtttttgaagacaggctgcggaaatctgtgtatacacttttttttttcacagcataacaacccaatttgtttctttaatctgaaaaaacaaaggcaacttacaggtataattatattagatactatacagcatcaacattatttatgggatataaataattgactttcccacttgttaaaagaatcctaccaaaacaaaaccaaaaagagtaggtcatttgattttctatgcctcatggttattatatagatacatttggggctctaaagtcattgttaccccgtacataatctgtaataagatgagtatgtaaaaaaaaatgtacagcctcattttctaagctcagcgcacatgagattggctcttcatagtaaaagcacatactgtgacaagcacatgtgacacaacacagacacagtcactgatactcttgacaattgccaagatgtccaggcagagccttgatttaagtgagtctggacgtatgctcagtactcagtgcgatgtagcctagcctttaacatccaaagcaggctttcttgttagaggtgtgctactggggctggggagatcactcaggaaactggttttgcctggcaagcatgaagacctgtgttcaatccccaccacctatgtaaaaagcaaggcttggtggctctggaaaggtagagagagatagacccctcaggcgcgtttcccagccagcctagcctacttggtaagttctttgccactaagagaccttgtcttaaaattcaaggtgatggtgcaaataacatgtacacacacatacacacaagcacacacgcaaatctgctaatgattaacagcagaatgagagcagtaacaagagagggcaggaatctagtcgatacaaaggcttatgcagaacatgtgaaccatctatctattcagtctgcaacaatgccagcttagctttatgccccagggcacatgagtcttcctgatctctaagtcttgaagtatgggtctcacctttatatacccaatgccccattagaacaggtattttgaaaagccttttcaacaattaattcgttttgttgttgttgttgttgtttgtttgtttgactttgatggtctgaggggtgaacctaggatttgtgggtgctaagcctgacctccactatggatggtagccccccagcctatgacagttcatcttagaataaatgggactggcaaggtcttcctggaaaaacaatgttgcaaatagcaacaatgttgcaaataacaacaatggtgcaaatagcaacaatgttgcaaatagcaacattgaaataatacagccctccctgtatttactcagtaacacacacacacacacacacacacacacacacacacacacacacactaagaactgcaggggttggttggttcagtaaataagaacaatgaattgttctccaaacatgaagtcctgactttgaatcttcaacactttcattaaaaaaaaaaaaaatggctatacatactccagtattgggggcaaacataggtagattccccttttgccccccaaaactaaatcccacatggcagcatatatcatatgtgtaactcctgtattggaaacagacataggcagatcctgagtgttcatggcccagccagcctatatgaaactgcaagcccaggctcagtgagagaccctgtctcaaggcagcaaggtgcagtgctagaatgagatacgctaaggcctgctctgcagtgtgcatggaccaaccaagtgcacacacaggcacacctgtgtgtacacaccattcatgacatgcacacacaacactatggagccatactgaattcataaattcagagctgaagtgggttctggatttacattaccattaaccccttacatccagtgggaagttagagagccgtgtagggtgtgggttgctgcagtgaccctgtgtactccggcattcagtgacctggatcctcacccccactaaatggcagtcatgcctctctttgcttagtctagggactaaacaccacattccccttgggagagtagccagggctcctaatggtcaggtctgacgttccattacagctctgctgtgtgactgctcacgtgactgagcctctccagccactgtccagcctgagataatctgtatcttcgttccttgcttaaaggcagtttgagaacattttcgtggagagctctttaaaacaccttttcaatggagctgggtcttgttggagcggcgtggtcattctctgtccagatggctcaccatgcgcctaaacagtatgcccttcaaatgaataagtaataaaggcatatgatacagtgttcctgctgtgcattccccatgttccctgttctcccctacacacaccctgagctactaaaaatacctacagctctcaaaggatttcctttcattgtccatgaggcccttcccagcatagattcaaatgcttaccagaaagggcctgattttcttcaacaaaaagagtcaaaaaaaaaaaaaaaaaaaaaaagagtcaagaccagtagatacctggtcatttagttcttttacattgagaaaagaaaaaaaaaaagagttaagaatgtggatggctctgatgagagtattttcaggacacgtcagggcagttacttacacaaatggattcagacgttgagacggtcagaaggcgagacctgcacaggatctgcatcgagtgaagaggtgatcatacgtgccagccctacctcagaactttggcagttgatggctgctgcgagccagggagtcagttctctccaaagatgcggtccgcggtccagtagatggctctccaccaatgtgcacgctggcggtgctgagtggactctatggctgaaggaaaggacacaggaagttgggagggaagaatggaagagggtagaggaggaattggggatgagggagtggagtgggaactttggtcaaagcacagcgtgtgtatatatcccaaattctgaaaggcaatataggtagacaagaaacagaattttttcataccgtaaacaatatcataaaacaaaattttccagtcagggaaatttgtcagaattgtgttcttacctcagtagaatgaatagcacttagaataatgtctctctacacactagtaattttcatcattagcataatacttgtgggtgaggaggcaaccagctgtacaccttgcctgtgcaccacaggtacaggtgctaccctgagccaaacgtacattttctgaggtgtgactgtcaacagcgaggggagcttcgtttggccacaccagcaaccgctgcaccaattagctcctcggcatcaagacatttaaaaaagtagagtcaccctcttcggctaactccattttacaggggtcataaaaatcacggttcatatttgcggtgagaaatgagatatagagaaactgtccatgtcattgttgaaacagacagggcattcaataaatggaagcatacagcatgagaaccttcaatgtaatcaatgtaatcaatcaaatatcgcgagaagcttctgaagtgaattttcaaaacaatcagtccttactgcaataaaaagaccaggtgctgttaccttcctttttccataagaggaaacaacctcggtggctgtttggccacagtcacacaccttgacaccggttctgggtttcttcgatgccattcctccacttctttctagaccacgttgccagtttccacaccagcaaagtcaggaccgcttcagcctcctgacacgcccaattctcttaatgcgctcagaagcgcaattggcccattttatgaagacaactctctgtccttctgttccctgccgccattcttatcaactgtgccatccattcagaacggatttggggttgtggtcactttcgaccacttggcctgtgagcctctgtaagctaaatggttgaaactgtgggtccccaaggctcccatcaaactcccgctggcttccctccaccactacgctcagatttctttctctcttttacacttgccagacctgacccaggggacttcctcctcccttgccttcatctgcccttcagccacttgttaatccttaaagcttggttgccctctctctcccttccttatttcttcaaaatccagtctgagctgagggaagttgttttctgacaagggacagaacaccgccttgggaatgccaggcggtgcagagtcaccgtggggattaccgcgcttagacgttgttttctttggatcagtcccagaacgcgtacaaaaggatgattgtgactgtcagcagatatgacaggaaatggtctcatttcacacaattcagatgaatgtcatctgtagagaggaagccagccatttcaaaggagaaacgggggggggggggagcccgtgggttacttcttctaccctaaactcagaaggaatttgcttcactaaatggcaaaaagcgttgctcttccgataaactcatatttgcatttcccctggcaattgaataatcccttagtagttaattaactgtaaaagaagataagattgagtagctgtaggaggaggtagcttttaagtttactgctgggctgggcataatctattttatttctaatcaaaagccaagaaaccatctctaacctagcccagaggaaagtctaccttccccagcctccgtctttgatcctattgtacatcctggtgagtgctctatgaccacactaaggagacacgttggcacgtcaggggcgctaagcctttggaagtggtacccctccccatccttgatgcccaggattagctcacaaaggttcttttttttcccagctgctcctttttcatgacttgtttattgcaaatgctttcccttgctctgtgttcagaagccacgacttaaccatcctgatttgtctcctttgctctctgtctcttgcttcctgcaccagtcgagcctgttgacgcccgccccgctgctgaccgaggactgaccactcgaccaggtatctgactcgccccatttcgcctctgctctcagcactgtgcgcttcagcaaacatgcctctctgggttgcacgtgttacgggatagaatttaaaacgactgtaggcaccaagcatgatttcagagtcttggcttctccttatgcctcatttcccaagttcctacgtgatctagtgtttgtttgtttgtttgtttgtttgtttgtttctgagccttctttctgaaacaaagagagtcttttcaaatgtggggctctttttcttgatttcttccttttttaataaatgaagagtgtgatgtggaccctgtcctcacacacggtagaggcccagggaggtgtagatttcagtgggaaattgattcttgctgaagacatctccttcctctcttgtttagtattcatgggggtccttgagtggcctcagacttttgttggttactaacatagacacaatttccttaaaatatcattattggtatttctccagctccagaaatacttagtgccctctgtggattgactatgcttacgctcagccagtggctgaagtaacacaacagatggatatgcataattttgcagagaagcccttttgtttttctgtcttacaaatttcttcactatcaaaatagatatttctttttatacagtttcccaagattaaaaagaaatgggtttcgaccccctattctatgtttagcccccggctaaacttaaagtcttaagaataatgtcacaccgcaagagacatagaacccgcttgtgtctactccttgcacagcctcaccccactgatagtgaccgacaaagtgaatcagagaggggaaagtcaatgaattggaagatctgtgtattgtggagagattttcttccaaatagcacataccttcccacgtttactttctttatgcccagatcccatgagatactcaagagcaatgttaacatcccttggggacatcactaaagggaggtagttttgcttcctggttcagaggtatccccagtaagaccagatatggccacgcccctcttcttgccattcaaatctctagccttggctgctgccagccatggtcctagggaaagactttgagagtccttctggcatcacactgatcccatgatgtggttcagcacctgagcagaaattgcagagtgatacgtcggaggacagctgacctcattgatctgacgaacgtcttgtctgaagtgcttttaaaagaaccttgagttatataagttgtacactctttgggctctctcatgtcctctttaatgacagtgtcactaagtaaatgtccagggaaccagcagttgaccttcccatgctgttctgccagccagtgaagcccaaggcagggccagtaagtccagtgagtcctcaccacagctacaaccagctcaagctggtctcctagactttttaaaatagcacgctactcgttttatttttttaaagatgacctattttttatctataaacataaaatgtaatattgaggcgtacatccagccgattttattacattcctctattatataaggatgtacttgttcctgttcaaataatccagcactcacacagtcaaccagctcatcttctcactctgtttatgtaaactgaacatgtaaaaggcattttcatacactggcaaaaaaaagtcatctgttttgagaaaagaaactaatggcgttctacagaacagggaaagcctacaataacaacagtattatcccatgagacatcaatgttgtaaattctgtgaatactcaaaaagaataaatgataaggttcttgctcccgggggcctgagatgtaatcaaaaacaactcactttgaatttagagaaagatgggaggacaggaatatatgaggacacacaaagacgtttggtgacagagcatgttatccagggaactctctggaaaggagctttccacagagagaggggagtgggagatttaaggcccaggggagggcgaggaggaaatcagttagattagaaactgtcctgggcttgtccttgtaagacctgtatccatatatccacatccttccaaagatagccaccgaagaggaagatggtatacaccaggcatgcggaagccagctaagctgcaattatgagcatggaatttgctcaccgtgtctgaggagttgtgtaggctctatcatctgtacttctgtgttggcaatgagtctgccgcatattcagactgataccttcctacgctgtgcacctgttccaataactctacagccacctgttaggaatccacactctggactctgccacattgcatctgtagacttttccggtcttagatgcccttcccaggattgccctccaccattgctctttaataatctttcttgtcactcagaaacaaagaaatcaagggtgtgagttttggcttagtcctttctatgccctgtttcacatcaccatgatgaagagaatgattttctttcttatctgaaaaaccaggatattgtaacttttagaagatagtgtcacccacaagccacagcaataatgatgccgatttttagacacagtgacaatcccagctactcactcttcctggaatgtttccaagcaaaaactggactcttgcagacaataagaaaacacatcagcagtctcttcacttggtgtgttaagctaccccgccattattccctgtcccatccttctccaggcctaacaatctagtttcgtgaccccaagagatattttcctattgatttatttcattgttctattgttttgttaatctctctgtaataatattgcttagtgcgtagaacatcttctaaatgccattacgtgctgaacagcagtgaaagagggactctttctgctgagtcttacactactgaactgtgaacattgccagtcgtgctagcatgtgacgtgaatttgattttttttttttgcctttttctgtcatcagatacactgtcagtgtcctctccaccataccaggagcttatacggttttaaatggggacgtaataattgacatattcatcgcaatgctgtgctctctgcctcccccaccccctgatataaaagggaagactacttacaagttttcactaaaatctcagaagtaactttaactgccgtgttactactcgcatgtggtgagggaaggctgcattagaaagaaatcactgttgatctaacgaggaagtaggtcaggttttataaaggtttggaggaagatgaaaataagcaaccggggtgatttaaagagcattcatgtcactgccacattagaaaaaaaaatagtgtcaggaagtacagagaacagagtgagttataatatgaaaaaaataaaggtaatttttttaagtaatgtaaaaatagaaggttgcagttcttcaagtagtatccaaggacaagggctgtcgaatgaaaacaagcagagctaatgagatgaaacagaaaggggacttacaggtctcgttgtgtctttcctgtctaaattaataaaaatgatctcccgatgaaaggaaattaaagttcagatagaacaccgtgagaaaagaaagcgctaagcctttgtattcgttgcctagtcacctatcgctgtgtaacaagtagccccagaacttagcagcttcatagagcaagcgtttagctccttacagcagtttcagccagccagcattttagcatagggcagagctggctggttctggctcaggctctttcatgaaatcacaatgaagacactgccaaagctgtggtctcctgaaggtctggctagagctgacagagatcaagcactctcttggctgctgtcaggagccttcggtaccttcccatggcagctggcttcccacacaccaagaagtacaatagagggaataagaaagaagctttggtgccttttataaggcatcagttctgccatgttctacttacatagataccatatcatcccctgctccggagaacaaaagaacaaagttctggttttttgaaatcattattaataataaatgtgtgttgtatactcacatatgtagacaagtacagttccctacaacccaggctaagaacacatgaagaggaacttgaacaacagtggctagtcattgtgagagttagaacagaagagtaggaaggcccagctagaaggaaatggggaagtgtgatccagaggcagaagcgagggagagcagcattgtactgtgagcagattggcattcatcatgagcctggtttacggtgggttgtccaagggaagcgttgtgggcagttagacaagaggtggtgatgagtcacacccagcatggactgcccaggtctgtcaattatactcactctcagcagaagccatgctgactggctgacgggctttctcagtgcttatgaccttgtgcttttcagggtcagcagggggttgacaagttttccaatacttgatggacaagattggaagagccattagacccagaagaggcaatgagttcccacaggagttgcgggaattcacaatgtgtagccagagaaaggaatcctcactgccttgcctttaatgtctgacacacgtgctcaaacctacctggtgtcacagatagatgcctggctcactcgaaataggaccaggccctgcggtgtaggttacagggagaccgtgttgcagtaatctgtaggaaacaaaatcattctctctggtatgcaaactgacctctacctttgaattcacgtaggtgctaagaacctgcctccattggaaacatcatggaggaggtggctctaaaagcccttccttcatagcctcagattctacttcagtaggatcacttcagaaaacacgacaactgatgcaaacggacatcccttctgtctgtcttcacttccatttctaaaacatattttaccttttagttttgagcctcagatgaatagttgaatcatgaaacgctgtaagaattggtccaagaaccatgcagccacgtatagagaaagaggaattaggtaatgaattctattgatcccagagacgctctctgttcattgtgtgctcctttcgagtcagcggatgaagcgattccacggggcgtgttcagctagagagctgggatgctgagctaaacaaattatgtgactgacagtgctaccgccgtgcagagaaatatgaacatgatttacttgcaattagaacaaagctccaaagtaatggatttgttctcccaggtcgttaaagttcatttccaaagccgtgcatttcgtttttctttaagcagtcccagcccataaaaagtgcacacataataaacaacaagccgctaaaaccaagtcaacatttcttaggtacaatttaacctggcatcttaaccagcattgatttttcccccctttccctccctccccttttaattatggcatgtgtttggccacacaggcattacatattcagcgttcttcagtctttttgtttgctaggtggtggttaatggtttaaatctagggtgtcatttttcttgagaaaaatccctaaatccgtttttcctaaaagctctggccaagagagaactttaaggcagtttttgcctccttgtggctggcggtcacactaacggatggccctgcatactttgtgtttgacgcaggttctgggctgacaaacatcaagacggaagagatctcggaagtgaagatggatgcagaattcggacatgattcaggatttgaagtccgccatcaaaaactggtaggcaaaaataaactgcctctccccgagattgcgtctggccagatgaaatacgtggcacctcgtggcttgtcctgtgtcaaaactgagaaggactactgggaataaaaccaaaatgcctgcctagatcttcacaaagataggaaggagaggaagtggggctctgttgatagttcttgctgagcagaagccgctgagcccaggcggaacatacaagtgtaattcagtccaacgttgcagctacgtgagctgacttcctaggaaaatggttttttcgggttaaacacatctaatcccaatatccaaactggaaggcaggataccacaaacaagaaattcaagtccatgaggctctgatattactgtgtgggggaagcataagtgaatttcatttagaggtggtcccagtttccaagatggtctcattatgtaaataccaaaaaaaaaaaaaaagttagaaatcaagattttcgaaacccttttggtcatgaccattctcggtccacgatagttttatttgaagaattggtcttaaataagcatgtggggagtacttggttgtagggatgctctctcgcagtgcttggttaagttctcatctacaaatggataatttcagtccattccaacccctcctccttcctactgcttccccacctcccagtatttctttggcttacaagggaaagttagcagagaccctttaaggtgagtgaagcccagcggtgactttgccgcctcagcttctcagtcagaaatcttgggcaaggcagatagcagtttctctaaagacaatggcggttttcttcctaatgtcagaattagaatgagtagagaagcacgggtcttccttataggtaggcggagattatataattctctaccaaaacctcagaaattcaaataagccaaattccagatcgttagagttccttccatgttaccagttatcacaataaaggacttgagtgggaattttaaaaacggtaagaaaatacctgtatagtggtgcttgataagaactccagctctgtggttgggtggagtgtgggagactgcagcctgattcctttgtaaagtatcttcccagtgtttgtaaataaaatgtgtagatcctagtatgaatctccaaaagaaagggcctttactgttgggcttctcaattctggattattgtagcaaatctaaagctggcttgggattcaattttgcattaatttttttttcctttttttattcagaaaaaggcacccagccttctgaaatgtagttttcgttggaaagtttattgctgttttgttattgtgaaaccagaggcactcctgagcaggctgaaactgcaaggtttcaaaacaaatctggggtaactgctgaaaggctggctgggggtcggggcgtggctcggaagatgagtacccaggatcccgttttcctgagctggtgtcatagacgcccttctcagtaattacatgaacttctataatgcgacagtgactaatgacagccgcagcaattaggggtatcagctccctctactgcactagctgataagataatgtactataattagtgcaatgaatattacagaattacagtatttccttaaagacggagggatatatccagactcacatttattcccgatcacctcactgtagtatcattagttaattaatgatctcctttaataaatgtgttgagctagcatttttggttggcgaggggattaattacgagccatttctaattttgccgcagatgcgctgtgagtaacatccacttagaaaaattttatctgctctagtttacctcgcctttgcaaactgcagcagggatggatttagcgatggaaatcggtcattcacctatcttgaagccgcctggaaagaattatttagggagctgttggcactaacttacataacaaatgtgctctagatcgttaggcacagctgcccctccctccctcgtttaacccaccatataagatcatctcttatataacaagatgattaaagtgcagtctgtatgtgttatttcgcctaagtagataaagctgggaaccactggcttgcttttcaaaagagcgtggagacgtatgtatacactgcagagactttctcaccgtgaatacatttcttctttgtcacgttctcaggattcttttttatgttcaatataaacaaccagagtaaagcaatattgccaattttggtttctaggggcaactggataaagtatgacttgtttgttacactgagattctctttgcctactgctgcttcccttggcaaacatggcgcttttaaaggagagtatgcgttctgtggttaattgaatctatgtactattgtactatgaagaaggtagcttggctgtccttttctctctgattaactcctgtgtttcagaacgttttttgacccatatagaacatgtcccttcaaagaaacggaagcatgcaggtttgaaacctagctaagggcaaagtcacctgctgtgggcaggaacggagtgacctgtttccagaacaatggcggggacctctatttggtttttaccaaatgcttacctgttaaagggcttcagatccctgcagacttctacctcatgatgcaccagagaaattgacttcagaacccgggaagccacctgttgctcattgttccagagacgaggacgctcagtcctagggacccaccaactcacgcttcgctgagctatggcggagggtcccctgaaactttgctacatccgttgcctcttgcgcttacagacctttttctcggcttcctttcgaaggtgttctttgctgaagatgtgggttcgaacaaaggcgccatcatcggactcatggtgggcggcgttgtcatagcaaccgtgattgtcatcaccctggtgatgttgaagaagaaacagtacacatccatccatcatggcgtggtggaggtaggtaaacctggaggcttgtctgcaagtgggaggcaagccaggaagtacaggcactggcccggggccacttaggagaaaagcaacatccctctgtggtactcagggcacagctgctctctcgctgttttgcatccacccctgggtgccatgaatttaatgtgctctcattaacattatgcattgttacttttaacttatgacttgtattgaaattaaccaaactaagactaattatgacgctcagctttaaaaatacatgtatggtttctcttaaataacaaaaatggtatcagaagtcaaaaaacggaacctagacgttcatttctgatttgtattttttgttgttttgtttgggcctctgattagaaccaggtgatgataaataatactgattttttttcagtaatgactcctagcattaatttctggaaggaagtggcccagtagcgaatagctcagtatagcatgcgtggttaccatggaggaacattcaggctgttgccctgaacttccacctgagcagagatcgtagtttcccggagttagtggagaagcacagggagtgtgggatgaggtacacacgagcccttcacactgcatatatgctggacttctttctgcccgcagagcagccaagcagggacgcttaccacaaaagtcagtgctacgtcatcaaaaaagtacaggactcgaatgtaactccttccccgtcttgattcggggaagaaagagtgaaaggaggtagattcacaaacatttaaatatatttgtggtgacgggaaagttttaaagcatccctgtgtgattaacttttagatatataatagtataaaccatctagaacccaaagaacgccgagtccaagcagatctcattttgtaggtgagaaaagtcgatcaaataaaaagaaccgcacagtgccaagcttaatacagtcagggtttcccccattctacccattgatttccatcagaggccagtgttaagtaagcatctaattaaacccgaagaaagtgctctaagccatccttaatcatacaaaggcagggacagtttaataaactcaagctaaagaaagccagagatctcacattcattggtccttagattctcgacacttcattcgtgaggatgctcatgggaattactgtgggttttattttcctgtcctagttgatgtggatatactaaagaccagtgtgttgggtgaggcccaggaaactgagggggcaagaggcgaaagagctgaaaatttcacacactagagtataaacatgttttgttttgtttcatttttctcaaagcaataactctggggctggagagatatccagtaaagtgtttgccacacaaatgtaaggacctgtgtttgggtctgtagcatcctcacaacacaccaggcacaacatacccgggatgccagtactggagagagacacgtgaacccaagggtttgcaggaatcgacaagctccaggttcggggagagaccctgactcaagaaataaggtggagagctttgagaaatgcctacctacatcaacctctggcctgcgcatgcacatgtccacatgcaagagcatgtgtgtgtacatgcatacacacacacacacacacacacacacacacacacacatgcacagataccaaatttggggttttgttctttctataatggcacctaagttttgttcttcaaggactgtaaaacattatctccaatgcatctttctctcgtttctaatgaaatctgttttccccctacttcaatcccctatttgcatatgcgaataattcaaaaactcctttgaatttcattaatagaattcaatttaaatggtcttacagtggaatgactctgtccaagctgggacttctgtctgggaggaaaataagtctgccaattcccatcttgataccacaagccagagcctgtctctgcttgctgagtctaccagcaaggtaccaaggctaccacagagagaaccacagacagagtggatggcacaacaaaagtgtactttcctgaccagtgatggaggttagaagtctgagaccaggctgtcagcagccttggttgcacctgatgcctctctccttggtttgtagatgtttgtgttctcccatggtctcccgggggtcttactatgtcctgatctcttccttctaaggacatactgggctacagtctgcccacatgacttcatttggcagtagtcattatagccacaatctgaagccttggatttgataggggcacattgatacccagtaacaacaacactgagcaacaacaacaacaaaaaaaggtgtgatgttcttaccagaactccattcacgctgagacatgggaattttctcgaaggcttcagtataacacacactaatgctgactgctttgaggtactctttaggcaggctttgggtagcaaaaaatgataccccctcacctcctaacctaagccccctcttaaacaccttcctgcaacctggaccgagtgattcttttgggcagtaaccaagagacactgcctcttcagaatgacagagggaaagaggttgacatgttgattctaaagaaacttcggcatcctggaagggtcactgctcggcgtatccaagtggcatcttcttgagcgccactcaagaaatggtcttggttttcacttgattccctatagactcactttgtcctggagagggatgccgtggagagtctgaaatctctttccctttaacagtctgtgtttctgtccgtgacgaggcttggtccagctccgtattgagtccacactgggacagagggttgaaatagaactcacttgtactgctgtgcctgtaccctgcccttggggaggtgtcatttagctggagtggtagaactaggccaccgagagctactcttcagcctggggtgtcagtattgaagcacgctgccatgggcttcagcaagcccttcatctttgagtacctcgggaatgcgcagggtggatgtcaccctctcctgcctgactttggagcgctgcacacactcggccacagtgtctccacagccacaggttgagctccccacccccgccccgccccaactgatcaaaagtatttagggaaaataatgcacctgagcatgaacagattattccataaataatcactatgacaaccatttgcatttagattgtatttggaattatatgtcacagtcatctgggggtgcgtagccatgctgtataggggagaatgtgtgtaggtcatatgcagataccatgcgttattaagcaaagaacttaagcacccttcctctttggttttggaacccatctcctgtgtgtgctgaagaaacgctgcacgtacgtggaaatgacactattcccggctctacttcatttccttcatggatgagcagacctcattcatgtcagtaagaacaaaaaggggcaacgaatggaccgagtgtcccggtcactcaaggccacgtctttgtatttttccatcacctgggcatggtggaagcatgtgtctcctgagtatctcttgtcctcacaatgaaagactcccatgggtcacaaagtagcaagcctaggaaaactgtggagggaaatgtgggcattcaaagaagcctagtggctattattattattatcatttattattatttttgatacagtaaatagccatcaggcatgagcagttggtttggattttttaaatattttttattacatattttcctcaattacatttccaatgctatcccaaaagtctcccttaccctcccccccacttccctacccacccattcccatttttttggccctggcattcccctgtactggggcatataaagtttgcaagtccaatgggcctctctttccagtgatggccgactaggccatcttttgatacacatgcagctagagtcaagagctccggggtactggatagttcataatgttgcacctacagggttgcagatctctttagctccttgggtactttctctagctcctccattgggggccctgtgatccatccaatagctgactgtgagcatccacttctgtgtttgctaggccccggcatagtctcacaagagacagctacatctgggtcctttcgataaaatcttgctagtgtatgcaatggtgtcagcgtttggaagctgattatggggtagatctctggatatggcagtctctagatggtccatcctttcgtctcagctccaaactttgtaactccttgtggtttggatttttaatacctaagaagtaaatattaatttaacgatttgcttaacatgatgccaaaggttcattctgccaggaaggcttcctactttagtaacagctatcatggcccttgagtattgcctcctgaacatgcccacaatttcagtctgttgctagaggcacacagtggtcacagagggattggcacagtcctcgaggtagctttgagggcccttgctaggaggaaggctcatccttgttctttgtttagccggaggtttctccccagacatgaatattcacttccagaattcaagacgattggggattaaaagatgccatttggactcttctcctcgggtgcctttaaaagcaatctattcggaagcccagagccctgtgaacactgagggctaagctgtccccatggcaggaatcgtgaaccccttctgcttcccagcagcaaagggcatggaggattagcacgcaaagcaaaccaagaaaagacagggaattgagatgcccggactgagtccgctctcggagccttggatctccggtggggctcccttgagcatttattttggagtttgaagtcagaaaactaaataacagtactaaacacgaaggtgctctgctgttcttggaaaatgcagaagactgttggcaggcagctcgagagccgctgcccctcctcgaggtatagacacactaagaaacagcagctacatgcttgatctccaaagcaagtttatttatttatttttttaattcccttatttgacatttcagttatggggtcctagagagtggagaaaatggccaggttcaagtggcacaggattgcagacaggcttgtctctagcaagccgaacaggagggtgactgaatgctctcactttggggagttaatctgtagagagaaggcattttagcttgcaagcctgtcgccaattaaatcgaggtgacctcatttgttgacagcagagcagatcacagcaaacaggaggagatgggaaaaacacctgtgtgtttctcccaaggggcagtgatgctgagcagtgttctctgagtgctagctcctgggtaggccttggtataagaggaaaacacccaggcccttactggagtgacctggagactggactgcaggcaactctcacaggagggaagatgcgagcagctcccatctggatcccacctcgtgcagatgggaggagtcagggcggatgagcagaaggaaatgtcccaggacctaagggcagggcagctcctattcccactgcctttgactgtgtcctgaagtctgtcctgaagtctgtctcgtgcccagcctaaaaaggactaactagttctctgaagtggggtcacacccaatggccatgaaggaattcatctctacaaggctctccacctgaattactccttaggtgggactaggcgtgatctgtgtgtatcatatgatctatgtgtatcataccacatgtctgtccatcacctggtaggtagggcagcactggcaccatgcatatctgccccccccttgttgttttaggagccaccataacagtaagacagttgtgcagggtctgaactgtgccacactggcagtaggcggggtgggggcaggggacagagacaaagagaaagctggggaattgccagacatcatttgacagtgctcagcaatgggaactagagacctctgaaaaatgaggctgcaagctccattcagtccaggacagaataagaaatatccctgtgaaatgaatcccatagaacacaccttaacttttctgtgggaaacatggtttatgctatgtgcatacggacagagtcctctcgtcttccaacgcggctttacagaggcttggagctcatattaatccagcagactcaagcaagcacctcctcttctcctcactgggagaggtaggacaaatatagaaacaagaaaagccattagctactgtagagagatgtgtgccccgcacagtctgcagagactaacacctgcccggctctccgtgacaatggctgaggcagattatgtttaccgtgccgacctgatcttacagctgaagcctgctgtagagctctggcctggcggaaatgaggcctgaatgcaacccccaggactacaaatcctgtatgtgtaggatgaatgggtaggtgggtggatggatggatgagtggatggaaggatggatcgacagacagacagatatgtatgtatgtatgtatgtatgtatgtatgtatgtatgtatataaattaggatagtgtgtctatacagtttccctttttgtgtcaagtaataccccccttttttcaaatttttattagataattttttcatttacacttcaaatgctatcccaaaagtcccctataccctacccctggtaatacaccttttatatacatacactcacacacacacagacacacacatacatccatatatgttacctttatttataccccttttatatgtgtatgtgtgtatatatatacatatatatatatatatatatgtatatatataataaaagacatatacatacatgtgtgtgtgtgtgtgtatcttttatttaataggctctcaaaactctcattaacatttctacagagataaatgtacttcgaaatggcagcagatacctggggccccacaaagcggagtgttatattctgcacagatctaagcgtcactcacagtcattcacagtgcggctttgtgagatgttctttctccttcaccatcccacaaactccagtgctggctgtttcagccaatgtgccctgtgcagacccgagtactcgcctcaagaatttcagcaccacctagtggccagatgcagcatcggcgtaagccattggctctgccacgtggtgtcagaagttggggctaaagctgataaatcacggttgttaagtactttgggggcaaagaaaagaactgcacaccgtgtcctgttactgcctacgagtactgtgctcctttaaagtcctcggtctattttaaacccggatctctgtacctgctttctaggtcgacgccgccgtgaccccagaggagcgccatctctccaagatgcagcagaacggatatgagaatccaacttacaagttctttgagcaaatgcagaactaagccccacccgcgccacagcagcggcctctgaacttggacagcgaaaccattgcttcactacccatcggtgttcatttataaaataacgtggaaagaaacaaacccttccgtttatttactcaccctcggcttttgacagctgtgctgtaacacaagtagatgcctgaacttgaattaatatacaaatcagtaatgtattctcgctttctctctttacattctggtctctacattacatgattcatgggttttgtgtactgtaaaaaaaaaaattagctgtatcaaactagtgcatgaatagattctctcctaattatttatcacatacatagccccttagcccgttgtatattattcttgtggtttgtggcccggaaaaaactcctacttgaaatatgctttaaaaatcgatgggggatgcttcttgtgaacgtgggcgtctagctgcttctcctacgtattcttttcctgatcactatgcattttgaacatttttttaagtattccaaatgacttagaaaattctttttccatgactgcatcttactgtacagattgctgcttctgctctctttgtgatataggaataagaggatacacattgatttctttgtgcctgttttatgtgcacacattaggcattgagaatttgaacattttttttgtccatgtatctttggatctttgataaaaaaaaattaaaaaaaaattatccctgttcatcataagcacttttacgggtggggggagggagtgttctgctggtctccaattaccaagaattctccaaaaattaattttctgcaggatgattgtacagaatcattgcttatgccatgatagctttctacactgtattacataaataaattaaataaaataactccaggcaagacgtttctttgaagggtgattgtgtgggagggaaaaggcaagatccctgcatttatcaacccaaggcgcttcgtttaataatactgacagagaatgaaaagccaggaagagagtaagagggaagagagggcaccctgagacacccctgagggtttgtataaaattgtgttttcataggaataccttagactggtgtgattgtatggtgagagtttattgcttagtcatctagacccgtgagaacacctcatctggtcactcacacctaacctgtgagtctgatgaggaaattgtgggcgcacacagctcttagtgctggtaaactaactggtggagtttgttgtttttaaaaggctgtgcttccctggcttggttcttcctttctgtcttagtcagggtttgtattcctgcacaaaacatcatggccaagaagcaagttggggaggaaagggtttattcagcttacacttccacattgctcttttgtttatcaccaaaggaagtcaggacaggaactcacacagggcaggaacttggaggcaggagctgatgcagaggccatggaggatgctgcttactggcttgcttcccctggcttgctcagtttgctttcttatagaacccaagactaccagtccagggatggcaccacccacaatgggccctccccccttgatcacaataattgagaaaatgccttacagctagatcgcatggaggcatttccttgagggaggctcctttctctatgataactccagcttgtgtcaagttgacacacaaaaactaacaggttccaaatgtgaaacacacacacacacacacacacaaacaaaacaaaaacagagaaaagctgtagagttttgatttgggggttttgttttttgttttgttttgttttgttttgtttttcgctttcaagctagggtctcaagtatcccaatctaacctttaactcatgtagccaaagatggccttatcctcctgatggtcctgcctctaccttgcaaatattgggactgcagcatgcgccatcgtgccctgtgtatatgaagtgctgggatttgacttcaaggctccctgtatgctaagtaagttctctaccaagtgagctacatccccaggccctggaaatgatgggtagagcagctgatagtctgcagcaagctctggacctgggcactccccacatttttgggggagtcactcttattcgtggggatacgaacgttctaggatatttaaccgcatccgcctgattctaaccagaaatgtctcccgagctgtatgatgtctcacacgcctgtgactccagtgcttgggagggaagcaagagaccaggcctgcctggaaaacagggtgagatcctgtctcaaagagtgagaagcagaagtgtttccagaagacgttctccaacaccagaagacggatcaagtgtccagatcctgccaaacatctcttacggaagcgagttacaaaccactgatctataaacagtattttgacctttatattatgtggcatgtgttgtatatgatacaatgaacgtgcgtttgagtttcaaaggactactggctgggaagtgtgtgccttccactctgtgtggtctggaatcagactcaagtcatcaggcttggcagcaagtacttttacccactgagccttcctaccatccttcattttagcttaatggcctgtgcacacaaccttttattgaggatgcttgtattaattccagctgctataagaataaacaatagacaaagactaaatgtctaaacttcacatttttctattctatcagggaagaagattgtgatggccgtgtttgggttctagaagagacttcttcctagcttgcacctgaccgactcctcacatgatggtgagggaagtctctagtgcttcatcttccttgggtgttaaccccatcttgagacctgacctgacctagccctaggcacttcccaaacatcccatctctacatgtcatcattgagaactggggtttcaatgtaaatttaaatccagctgctcttccaaatgtcagggagcacattgttcctcctttattgtcctgtatctcaagaacgtagggatcagccaaacacttgtaccatgtgctagagtcatggtggcacacagcttgtgggagtaaccagccaataactgatttgatttaaggccctctccacagggtgtaagagaccagatagccttgggacctaggggaagaacaaataataatggtcttttaaaaagaacaaaaaagtgataatgaatcagccaagcaccttttagctttacatcacaatattttaaacgatgtttcagtataccactatagtatggacaaactgggtggaaacacctgagggttaaatttttcacagaagaattaggtgtgactacaccgaaaacacaggacaaattgtgagaataagatattatcattttgcctggcctagtgagaggtgataggataattctaagacatttacatctagtacatttctactgatgtcaacgaaattgaaagctgactcccatacatagttatgtatgacacttaaagtccaggccagccttcagttgtagtgaccgtaagttttagtttaattttttaatttttccccaaggaggtaagatttgaaagtgtggtgtgactttcccacaggagacataagcaaacatctatcccagagagatcatcaagaacaaagaaataattttcctgaagtctaacggcaaacattgtgtttattgggattaccacgggggaaatggatggagcactagttacagaggcatggttgactcaagagtagctatatcaccaaaaggcccacctctgaggaaagatgcaaccagctctctgcaggctcctctctccccaacagtgtgctcgtataaccttgagaaggaagggggacttgttgatattgtttcaggagctttcctagattggtggtcatttggctcctgagtctaaagaagtctcctggacagaatgatcttgataaagaacacactagcactcatcagggtgctaggacagggactttggtgtggttagcagggtgaatgacacagggtatctaagaagagcttagtttgtatttatccccagtgacgttgagactttcttgtgctcaaaggctattttacagttcaaaatttcaatttatatcttttgtattcagacttaatgtctatattagtatccacttggcaactcttctgtgtcacatttctacttgcagagtaggtttttgtctacagtcttagggttttaaggctgtgaacagataccatgaccatggcaactcttataaggacaacatttaatgggacctggcttaaaggttcagaggttcataaaggtgggaacatggcagcatccaggaaggcatggtacaggaggagctgaaagttctacatctcatctgaaggctgctaggagaagactggcttccaggcagcgaggatgaggggtcttaaagatcatgcccacagtgacacacctacttcaacaagaccacttcttctagtagtgccactccctgggccaagaatatacaaaccatcacatctgccctttctatttccagctgatccatcctgtcatatcaacataacttctgtattaactgtcatagcagaactcttctgacattttaaaacatttgatttctggagacttaaaatatgaaatcttctaagtttgttgtagtgttttgttttgttttgtttcaaacctagtactaaagctttctgagcagacataaactctgtatggaaatatcataccaggaacattaaactaacaaaaatcactgtataaaatcagcagcaggctatttgtacaaggtccactgtgtaaaatcagtgtcaggttatgtgtacgagttgtataagaaaaacaaacaaattactggcctaaagttgagtactgttcacgaaatatttcattgtgtgcataaaatatgtttcctaaaatatctaaaaggtgaaaagaaagggtcccacatgctaaataaggaaagagtgctcagtttgtgttttctggtagagtgctgttgttgttgttgttgttgttgttgttgttgttgttgtaatacattctgtaaaggtaaacacaaatattaattttccccagatagataaccagcaccagcccactaagatggatctactgaatgaagtacaactttgcaaaccaatgagttcactgacattacttgcagaaatattggtgagatgttacttacaaaaacatagatgactcataagcagctgcttcaaaaaaaacaaaaacaaaaaaacaaaaaaaaccccaagtcccatttgggtgacacttcacaaaaactgtatctctggagctctctgcatggcttgtaggcaggtctgcaggctagagagtccgctctccccagcagttacataagttgcttatataaccttggtttattgaataaatatgatgtgtctattgaactgatttctaaatatttacactcccagattactgctgttatcagcttcctttattgtaatagagaggtgcagggcagagactcataactggggaggagccttgtgaatctcctaaatttcaggaacttcctgatacctagagttgtttctaggatttgttgagtctccaggatcctcttccctggatggctgttgaggacttcctgagtcttagaatgtttgtttcaatacagaagaaactgctgaataacactccagtctttcctctagttcttaagttcttgctgccacttctgcaatattccctgagcccttggaataggtaatacattattttcatccatccatggccaagtcttgagtcctaattccacagcaacaggtgctgagtctccggaagcttgagacataataggagaaagggtttaatgtggctccagaagaacagggtccatgtgatagggaatcacagtggcaagagcagctctttgaggccaggaagcagagaaagagcgggatggagggatggataatacaacttcagcatctatcccagtgatgtgtttcctccagcaaggtttcaccgtaaaggatctacaacctctcaaacagcaccaacaactggggaccgagtattcagacacatgagcctacagggcacatttcagtttcaaactacagcaccctcgtacttgctttacatgatgtttatatactcttctcaccctttgtgagatttctttggggagggggagggttcataaaggtctaagcattttgttgttgttgttgttgctgctgctgctgctgctgctgctgctgttttatttttgaggtctaagaattttaccagctagatcttaggactggtcttggcttttcataaatattttttaaaatgtgtgtgtatgtgctgggggctggggttgaatgcattcacatataagttcacttgcccacagagtctaacagagggcatgggacctcatggagctggaattacaagcagttgtaagtcattcaaacatggatgctggaaatagaacccaggtcctctgcaagagcagtatgtgcccttaagcactgacccatctctccagccccttggggttagttggttctgcagtcagctattctaggggcccacctgggcctttgatgtgcatattcagtgttctcatctctaaaacatttccttgggtctgagttctaagtattcccttctgtattgttcttttcctctttgaggaatatgtggcctcctcctaccttctatttcaccctcgttctatctgacgctccttgcttccttcatatcagttttcctctttaggttgttttccttcttttattgagttaaatgttatttagatgagtttgttttgggcaccctgcagtctttcccttactcctgatgcttataacattctgtcttttccttgcttgttttcttctacctagtttttgttttatatatatatatatatatatatatatatatatatatatgcattatatatacatatatgcattatatatacatatatgtgtatatatacattcccatacccccagttgcatcttgaacctctttcattcattaattaataatatcaattacttaatactgatgttctgttagccttctatcttcccattgcctatagatccaatagtgggtagaacagggagaggaagaaaggttggtgagtctcctttctctctccagggtctttattttggatttccagaatccttctctgtcccacccatttctctcagaaggactgacgactccctgcacatttttcttgtttcttctctttgggaggagctttagcagccagtccccacatgggttcactaaccttgtctatactgtgatttccctctgacggctggcttcatttgttctaagtcttttgttccccttcattccttccccattcacttggaattcccatctcctggcccaggcctcccatggttttgtactgactgctgccagccagttaggatacctgttgccctctctgtaaacacagatcggtttacaattacattattttttttaaacatcttactaaggttgattggctaccctaaagagaaaacatttacattagtgtattttcaagctcttcaagtggtcccaatgtgtaaccaaggtgagggccttctttctgtagcaccatgtatttaaaataggttttataaagaggctggagagattggagagatggcatggtggttaagaacatttcctgctcttccaggagagctagtttcaattcccagcacccacatggcagcttacaaaggacaataacttcagttgtggcgtatctgatgcccttttctgacctccgtgggcaatgtatttatatggcacatgcatgcagtcaaaacactcacaaaataaagctaaattatatatattgtatgagcagtggtagcacacacctttagttccagcattcaggagatagaggcacatgagtctctatgggttcaaggtcagcctggtctacagagagagttccaggacagccaaggctacacagagaaacattgtctcaaaaatccaatatatgctacatattgtcaaagactgtgtcttagtcagggtttctattcctgcacaaaacatcatgaccaagaagcaagttggtgaggaaagggattattcagcttacacttccacattgctgttcatcaccaaaggaaatcaggacaggaactcacacaggggaggaacctggaggcaggagctgatgcagaggacatggaggggtgatgcttactggcttgcttcccctggcttgctcagtttgctttcttatagaacccaggactaccaacccagggatggtcccacccacaatgggctggtcgctccccctttgatcactcattgagaaaatgccttacagctgaatctcatggaagcatttcttcaagggaggctcctttctctgataactccagctgtgtcaagttgacacagaaaaccagccagtacagactgccaggctttctaacataactgtgtcattattttccttcgtgagtctttactactctgcattattcagatatgtttttctttttctatgtggactctgtgtgtgtgtgtgtgtgtgtgtgtgtgtgtgtgtgtgtgtgtgtgtgtgtgattttgaaagcactgaggtcatctcttgagacttaaaactgtattctggataaatatggatccatttaaataagctatgaaagttttatatctggaggctcctgagtttctggctcatctgtctcctgaccccacactgagttaataaatagtcacatgagaaatagtccttctcgttcatatatgtacaccaatagcttaaacaagattgtcctctgacttaggaacctaggttcttagttttaatggcctacaccctgactgtacaaatgactgttcattatgaacacacagaatagagaagaaagggcctaccttcaaaccactatgatgctcagagatgagtacaatagtttgctctgtgtgtgttgccttaattcatccaaactcctacggcagagtgcatgaaatggccgtgtctgaacaatggaaatgtttatcaaagctggaaagtcggggatctagaatgttctgcgtctggtgatggctcatttcctagttgtatattcatatgttagagaggtgaggagtctctcttgggcttcagttttgtgacactaatcctatttgtgcttgctccacacataggacctaacgagtccaccagaaccccattcagattccatcggcctcggggtcagaattggcacaggatgcagggagcgacgtgaacatttaaagcacagcagtgtctactatttctatcctgtgtgcatttacctcatttaccgctgtttcatattctgtggtccacatcacttgctctagcatactcatgttcacaacaataactgaaaattttcttaaagtaaatgtatttcataactttgtaggaatatttatttttcttttggaaatttttcactgtttaaattatgtttgaaatggtatctgtcttggactgacattcatcactctgttttgtttagtagaatgcagtttagtatttatttaagaatgctgtgtcttctgaaatttatagaggagaaaatgagggaaagcctcaaagatatgggcacaggtgaaaaattcctaaacagaacaggaatggcctgtgctgtaagattaagaatcgacaaatgggacctcataaaattgcaaagcttatgtagggcaaaagacactgtcaataagacataaaggccaccaacagattgggaaagaatttttaccaatcctaaatctgctaggggactaatatacaatatatacaaagagctcaagaagctggactccagaaattcaaataaccccattaaattaaataaccccattaaattcaaataaccattaaaaaatggggtacagagctaaacaaagaattatcaactgaagaatacctaagggctgagaagcacttgaaaaaatgttcaacatctttaatcatcagggaaatgcaaatcaaagcaaccctgagattccacctcacaccagtcagaatggctaggaccaaaaattcaggtgacagcagatgctggcgaggatgtggaaaaagaggaacactcctccattgttggtgggattgcaggcttgtacaaccact

SEQ ID NO: 193 - DNA, 2344 bp, Mus musculus
cggcggcgggaggcgagagcaccgggagcagagcgagcgcggggccaccggagacggcggcggcggcggcggcggcgcggacacagccagggcgcggcggatcttccactcgcacacggagcactcggtggcccacgcaggatcacgatgctgcccagcttggcactgctcctgctggccgcctggacggttcgggctctggaggtacccactgatggcaacgccgggctgctggcagaaccccagatcgccatgttctgtggtaaactcaacatgcacatgaatgtgcagaatggaaagtgggagtcagacccgtcagggaccaaaacctgcattggcaccaaggagggcatcttgcagtactgccaagaggtctaccctgaactgcagatcacaaacgtggtggaagccaaccagccagtgaccatccagaactggtgcaagcggggccgcaagcagtgcaagacacacacccacatcgtgattccttaccgttgcctagttggtgagtttgtgagcgacgcccttctcgtgcccgacaagtgcaagttcctacaccaggagcggatggatgtttgtgagacccatcttcactggcacaccgtcgccaaagagacatgcagcgagaagagcactaacttgcacgactatggcatgctgctgccctgcggcatcgacaagttccgaggggtagagtttgtatgctgcccgttggccgaggaaagcgacagcgtggattctgcggatgcagaggaggatgactctgatgtctggtggggtggagcggacacagactacgctgatggcggtgaagacaaagtagtagaagtcgccgaagaggaggaagtggctgatgttgaggaagaggaagctgatgatgatgaggatgtggaggatggggacgaggtggaggaggaggccgaggagccctacgaagaggccaccgagagaacaaccagcactgccaccaccaccacaaccaccactgagtccgtggaggaggtggtccgagttcccacgacagcagccagcacccccgacgccgtcgacaagtacctggagacacccggggacgagaacgagcatgcccatttccagaaagccaaagagaggctggaagccaagcaccgagagagaatgtcccaggtcatgagagaatgggaagaggcagagcgtcaagccaagaacttgcccaaagctgacaagaaggccgttatccagcatttccaggagaaagtggaatctctggaacaggaagcagccaatgagagacagcagcttgtagagacacacatggccagagttgaagccatgctcaatgaccgccgccgcctggccctcgagaattacatcactgcactgcaggcggtgcccccaaggcctcatcatgtgttcaacatgctgaagaagtacgtccgtgcggagcagaaagacagacagcacaccctaaagcattttgaacatgtgcgcatggtggaccccaagaaagctgctcagatccggtcccaggttatgacacacctccgtgtgatctacgagcgcatgaaccagtctctgtccctgctctacaatgtccctgcggtggctgaggagattcaagatgaagtcgatgagctgcttcagaaggagcagaactactccgacgatgtcttggccaacatgatcagtgagcccagaatcagctacggaaacgacgctctcatgccttcgctgacggaaaccaagaccaccgtggagctccttcccgtgaatggggaattcagcctggatgacctccagccgtggcacccttttggggtggactctgtgccagccaataccgaaaatgaagtcgagcctgttgacgcccgccccgctgctgaccgaggactgaccactcgaccaggttctgggctgacaaacatcaagacggaagagatctcggaagtgaagatggatgcagaattcggacatgattcaggatttgaagtccgccatcaaaaactggtgttctttgctgaagatgtgggttcgaacaaaggcgccatcatcggactcatggtgggcggcgttgtcatagcaaccgtgattgtcatcaccctggtgatgttgaagaagaaacagtacacatccatccatcatggcgtggtggaggtcgacgccgccgtgaccccagaggagcgccatctctccaagatgcagcagaacggatatgagaatccaacttacaagttctttgagcaaatgcagaactaagccccacccgcgccacagcagcggcctctgaacttggacagcgaaaccattgcttcactacccatcggtgttcatttataaaataacgtggaaagaaacaaacccttcc

SEQ ID NO: 194 - protein, 740 aa, Mus musculus
RRREARAPGAERRHRRRRRRRRRRGHSQGAADLPLAHGALGGPRRITMLPSLALLLLAAWTVRALEVPTDGNAGLLAEPQIAMFCGKLNMHMNVQNGKWESDPSGTKTCIGTKEGILQYCQEVYPELQITNVVEANQPVTIQNWCKRGRKQCKTHTHIVIPYRCLVGEFVSDALLVPDKCKFLHQERMDVCETHLHWHTVAKETCSEKSTNLHDYGMLLPCGIDKFRGVEFVCCPLAEESDSVDSADAEEDDSDVWWGGADTDYADGGEDKVVEVAEEEEVADVEEEEADDDEDVEDGDEVEEEAEEPYEEATERTTSTATTTTTTTESVEEVVRVPTTAASTPDAVDKYLETPGDENEHAHFQKAKERLEAKHRERMSQVMREWEEAERQAKNLPKADKKAVIQHFQEKVESLEQEAANERQQLVETHMARVEAMLNDRRRLALENYITALQAVPPRPHHVFNMLKKYVRAEQKDRQHTLKHFEHVRMVDPKKAAQIRSQVMTHLRVIYERMNQSLSLLYNVPAVAEEIQDEVDELLQKEQNYSDDVLANMISEPRISYGNDALMPSLTETKTTVELLPVNGEFSLDDLQPWHPFGVDSVPANTENEVEPVDARPAADRGLTWGSGLTNIKTEEISEVKMDAEFGHDSGFEVRHQKLVFFAEDVGSNKGAIIGLMVGGVVIATVIVITLVMLKKKQYTSIHHGVVEVDAAVTPEERHLSKMQQNGYENPTYKFFEQMQN

SEQ ID NO: 195 - DNA, 310268 bp, Homo sapiens
gtactaagtctccagatgattattaggttcttataaacacaaaatatatatgcttattttgtaatatcaggttgttaacttcatctgagtagttttcagcacatatgatggggataagtcatcagttatgacagacaacttccggagttacatcaccaatgttcatctatcactcacctttgcttcaaactttatgcatcatattcaagttaattcctattgcatgtacttctgatttccacctacaaaatgaacattaaatttattatttccctcatttaaaaaaaaagatttcaggccaggtgcagtggctcatgcctgcaatcacagcactttgggaggctgaggcgggtggatcacttgaggccaggagttcaagaccagcctaggcaacatgatgaaacccctatctctactaaaaatacaaaatacaaaaaaaaaaaaaattagccaggtgtatgtgtgcctgcaatcccacccctactcaggaggctgaggcaggaggatagcttgagttctggaggcggaggttgccgtgagccaagatcacgccactgtactcaagcctgggcaagacagcaagactgagactctgtctcaaaaaaaaaaaaaaaaaaagttttcaaatcactttttctcctttgcagttcagcattgtcactaaaggtgtccaggttagacagaactgggtacaaaccctcctttctcttccccttactctttcacctcttcatttgtgacatgcaatgttaacccaatacaactcatgagtattcagagatcccgtctgtatacgtcctcagcctgacatactgtaatccttaggcatccttattagtaataagatgtccttgtgtgattttttcacaaacttttcacagaccctatctatgttcattcctggaacctctggcacattcttcttccttctcttcccaatctcaactttttcatcctctgaatctccctatactttccccgtggacaagcctctagaaatgttaaaatgtcagatcatgattggtaaatctgtagtgactaattgcccactgctgcctattccatctgacctaaattcctcaggtcttctaacattaagacctcttcctggccggttgtgctggctcatgcctgtaattccaacactttaggcagctgaggcaggcagatcacttgaggtcaagagttcaagaccagcctggccaacatggtgaagccctgtctgtactaaaaaatacaaaaattagccggacctggtggtgcgtgcctgtaatcccagctactcgggaggctgagtcaggagaatcacttgaacccggggcagcgggggaggctgcagtgagtggagatcaaaccaccgcactccagcccaggtgacagagcaagagtcagtctcaaaaaaaaaaaaacaaaaaaaaaaacctcttcctatagctaactcccacttaccacccccatcatgaacactcttgatgtatttacatggtttctccttcgaacatcctcctttcttctttcttaatggttgttatcaaataccctgataaaaaacaaaaacaaaaaacctcctctgaaggtcccttattcacccttccaacgctacaggtctgtaactctcattttctttttaaaaaatttttatttttttaatttattttattttttttttcagacggagtcttgctctgtcgcccaggctggagtgcagtgacacgatctcggctcactgcaacctccacttcccaggttcaagcaattctcctgcctcagcctcctgagttgctgggattacaggtgcctaccaccacacctgacctcaagtaacccacccacctcgacctcccaaagtgctgagaatacaggtgtgagccatcatgcctggccaaaatttttaaattttaaaaaatatattttattttttgtagagacagggtctcattttgagcccaaactggtcttgaactcctaggctcaagtgatcctcctgccttggcctcccaaaatgctgggattataggcacaagccaccaggcctgatccttacttttcttctgatgaattcacatatatgtgcacaaatactttatactaaattgtatttactgatgtacttttttcactgtgccttttctttttcttgcccagatatttttctcatataaacattagctccttaatgggagcaaatgaaccagtttttttttaattcccacccaaagtgagaatataaaaattttttattgatccaccaatactgaacactttcatttctaatagttatatttaactgaataaattacacacgggacaaaaatgttatttaagggataaagttgggtgtttgctcagggacaacgttgtatattgaatgatttggtgcttttgtgaatttatcattcaaaagaccatcgtgatggctaaataacagaaaggagagctttattggcaatatcaatttgcaaacccggaagacatagtcttcggtgtatgctgaatgtggtctctcttcaaaagagaggaaggacagttgggtttcatgcctcacagggtctgtttcacacagtggagtcatacatattcagcaggtttggaggaaaagatatacatatttatgaggggagctgagtgcatgtgcaatgggtaaatatgtatgtgacatcccatgtacactttggggcagggttttagtgttaaaatgaggtaaaatttggctctttacatcaaaaggtgaactacaggacccaaagacagtttgtgcacagcctctaataaactggctgacactggcttaaggtctgcaattgcttatcagaaaagaatgtttgtaaggctggtcctcattccaattagagttgtagtggtctgggttgtaaatcacaggatggggctgatagttcctattattagggagtttagagccatagaaattgagaaattggtcatgccagccagtccccgaaccctaaccctgtaggtaactttgtttccttaaccttacagtccatcttaggtgataaaggggtgtctgttttggtatctcacatcacaaattgttggttggtttgtgtgtttgtttcatcattcaggatgttgtttctttagggaatgtgaacctgaattctcaaggcttgttagactgtaatgttcccattcattttaggtttagctcatgcttctctagccacagccttcacttggattttaaaagttgaattactcatcaaagtctctaggacacgaaagacaatccttaggtatgatttgaccagtaaaaaagagatccagctgccttgaagcataagatcccctcggctccaatgtctatcactaatattcagtgtggcaaggatcccaggccacagagctgtggcttcctgcagctgctctggggagtgactctcttggagcatgtgatgtggtcttccattgtgcaggaccagcccagtggcatcctttcaacacctctggcaagcagcctttccaagcacggtgccgtctgaaaacaggaggcatatctttcacatcctaggcacacgccctagggagtggtcagggttttgtccagttctcagcaaactagctacagctccatcccttactcccacactcaagagagatactagaatacaactgagagtagcctgatatgatgctaacctcgagttgcttttatttaaattaaaataaatcaaccagacacagtggctcatgcctataatccctgcattttaggagatcaaggagggtggatcacgagctcaggagtttaagaccaacctggataacatggcaagaccccatctctacaaaaagtacacaaattagctggacatggtagtgcgcacctgtagccccagctactctggaggctgaggtgaaggatcacttgagcccaggaggtagaggttgcagtgagctgagattgtgccactgctaataattaattaaataattaattaaattaataaatcgtgccactttattaaataaataaaacaagagtaaatcactcacaaatttggagcttttattagcaaaacattacttaggaaatctaaataaataacacggggttgacagccattgttctaactggcagcccctggcaagctcaaagccaggattatgctggtcacttaagtgacagctattgcgaattgttgttctctcaagaaaaaagaaccgatttctatggtaaaccaggcactgtgctgggtgcctttacaattcatcaccacaccacctaatgaaaggagcattcttcagaaactgtagtgctcaggctttctcaaggcctgagttcttttccaccagagcatattgttgccctattatccaaagttctctaaggaagagaactgacgtaagacccacatggctccattacatcttctggctacttgattgattttcatactccctacctctggggttggtatgtactatctatttctttctcctctcgttcttcctttttattccataaaatacaggaatattcctgtacattagtccttgcagcaaccttggaattactacattcctcaaacaagttatggaagccagctgccaatattggtccctggttaaacagtgaattctgttgttccatagagttactactgaaatacctaagccattttgtaaaatataatttagttgatctgaaggctgtctctaaagcagttttatgtagtgattacagagaaggactaatttcaagagtattttattgtttaaaaaaatgtaaacattttatggatgcactagtgaagtaaagaccaataaatgaagcagtaactttaataaaagggtaagtaaaatgtcacatcctctgcctatattcaggtctgttaggtatgtgtagttaaatgtaggtaagttagttgataattatttatttaagcatttctttatgtctactcattaaaaagaaaaaaagattaaaagaatgttactatgtgaaaaactgcccatcactggggaaaagaattttattatgcaaagcttcaacgctatttacagtttagacttttgtagctattgaaggctgacattgagataaagaagttaatcatgtccttctgtcttggaggaggtagaaagagatgagaatgaatacaattcaggatctacttctggtctttgatgaggagttagcacacggttctgggaggaaagacaggttaagaggcatgtgaaactctcaaatacgtcactgcgtctgccaacgtacatgatacccagcaagctcacatcttcatggaaagcatggtaattcccaacactaccggaagtctggagtggctaagtaatccatatattcaaccaggaagcagctaaagaaatattctaattacctaggaaggtttctgatttcaaaaggacatgaataaaaagtagaaggaatccactcccaaggacggacatcagagtagcttaaaatgtgagaataattttaggggaattttagaggtttggttatagacttatgttcccccaaaattcatatgttgaagccctaacccccagtaccttagaacatgactgtatttgggtagggcctttgaagagctaattaaattaaggccactggcgtgggccctaatataatctggctggtattcttgtaagaggaggagattaggacacacagaaataccagaggtacctgtgcagaggaaagaacgtgtgaggacttagcaagggtgcagccatctgcaagccaaggagacctctgaggattccaatcctatctgcatcttgatcttagacttttctggaactgtgagaaaataaatttcttggtttaagccacccagtctgtgatattttgttatggcagctctagtaaactaatacagattttaaatgtcattaaatgtcaatgtttaagctttgacaaaattttctaaaggaaagtataaaaggtcattttctttcttttcagagcctgatgattgcgggaggggtaagccagctgcatggggatcatgatgcaatgctgatgcaggacagacagaaagtagatctcttccatttctattttttttttttctgttgagttgaatgatcttcagactgaaaatgaaagaaaggtcactggaaataaaggccaaagatgagtgacaggattatagaataagtcttagctgttctaaagaaggacatattatgtacccccacccccaaattcatatgttgaagtcctaacccgacagtgtctcaaaatgtgaccatatttggagatagggtcaaagatgtaattaaggttaaatgaggtcattagcatggatcctaacccaatatctgctgtccttataacaagaggagattagggcacagtaagacacagagggaagaccatgtgagaatacagggagaaggtggccatctgcaagccaaggagagaggcctcagaagtaaccaactcagccaacacctcgatttcagacttccagcctcctgaaatgtgaggaaatacatttctggtgtttgatccatccagtctatggtaagttatggcacccctgcagggttcatctggctcagacttaacgattgcttttggtgatatttatagggcacagataacagcctaaacacaagacgacagaaacgcggcccagcagactatgcataaaatagaaatggggtatctggaccaattggagtctgcagtgggatgcggttactaaaacagtcaaatgcaacatgaggctccaggcagagtagtgggcaacatctcccatgttgcagcagtcagagcacacttcgagtactgtaaaaagacacagacaagccagaacacatttagagaatggccaaggtgtggaaggaaccagaaaccatgccattatgcaactgttgaaggaagtgcctgttttaccttgtgaagagaagactctagaggaagaagtagcatgaaaaccgctggcaaatttgtaaagatctgaagtgtggaaaagaattattctgcttggtcactggggatacaaggatatctgagtgggagtttaaaggcgggggatgtgagctttaaatgggataagaacattctagtaaccagaaatgcccaaagatagaatgcacagtctggagagccagtgaatatctcacaaatggagacacttgaaactaggatggggatgctgttgtaggaattccagcagacaagtggttgttggttccttccccaactttgtagggttataactagggatgttcctgcgttttctgcttggaggatctgcaagacacctcagggcaggaaatggcattaaatgcagaacagagctagtggctgaaaagcaaaaagccatcaggatctctgagtagtgaaggaaccagagaacatgcaggcaatgtccatcattctgacgcaatcagcagcataatcatcttcccccaggaacatcttgaccagggaatgtgtcagtgtggtgaatttcaacagtggaaagagaaactgctaaatctaagaactttaatttttatagattatgatctcatctctacaattttgaatttcatgctcaataaaagttccttactctctttttttttttttgagacggagtctcgctctgtcgcccaggctggagtgcagtggcgcgatctcggctcacttcaagctcagcctcccgggttcacgccattctcctgcctcagcctccccagtagctgggactacaggcgcccgccacgacgcccggctaattttttgtatttttagtagagacggggtttcaccgtgttagccaggatggtgttgatctcctgacctcgtgatccgcccgcctcagcctcccaaagaaaagtccctcactcttaaagttgcctcctccttcccagggctggcttcatgggcatgcaaccctggagagtctcacaggccctgcggtgggaggagccccatgcttggtttaacgctctgccattgccatcttaaaattcttaatttaattttttttcttttttttgaggtggagtctcgctctgtcgcccaggctggagtgcaatggcacaatcttggctcactgcaacctccgcctcccaggttcaagcgattctcctgcctcagcctctggagtagctgggattacaggcaggagtaaccacgctcggctaatttttgcatttttagtagagatgggggtttcaccatgttggccaggctggtctagaactcctgacctcaggtgatctgcccacctgggcctcctaaagtgctgggattacaggcatgagccaccaggcccggccttaaaattcttaataatgtaacaaagggtctcacgtttgcattttgcagtggactctgcaagatttgtagctttggaccacgtttctctttgcattcagataccttcttttttgccttatttgctcatgcagacccggaacaaatacggaattgcggtgggtaaatgtggtgcagaaagtgaacaactgggtttgtcctgtcactttaggcttttccctgctgtcccagcttcatgtcacttacttgctattagatttgggagttcattagcttcattttcctgatgtataaataggaataatagtaacagcctctttggcttttgtaggaagtaaatgacatgaagcgtataaacaaatactgcatgacaataaatatttgtccttatttgttgaggacatccaaaggacattcaggggcaaaagtaatccaagagtcaagactgaatgcctagtgcgggaaaagacacacaagacaacatttaggggagctggtacagaaatgacttcccaggaaggaagtctgtaccccgctggctgagccatccttcccgggcctaggcacccttgtcagcgcaatgagcaagggagagaaggcaggctgcagtgcagccctcagaagggccagagcactccctggcttcagtccttcgctccaagccctgtgtggagtgggctgtggcttggtaactaaatgctacttcaggtcaagagcaggggatatatctgggcagttctagagcattctaaactatctggacactaactggacagtggacggtttgtgtttaatccaggagaaagtggcatggcagaaggttcatttctataattcaggacagacacaatgaagaacaagggcagcgtttgaggtcagaagtcctcatttacgggggtcgaatacgaatgatctctcctaatttttccttcttccccaactcagatggatgttacatccctgcttaacaacaaaaaaagaccccccgccccgcaaaatccacactgaccaccccctttaacaaaacaaaaccaaaaacaaacaaaaatataagaaagaaacaaaacccaagcccagaaccctgctttcaagaagaagtaaatgggttggccgcttctttgccaggtcctgcgccttgctcctttggttcgttctaaagatagaaattccaggttgctcgtgcctgcttttgacgttgggggttaaaaaatgaggttttgctgtctcaacaagcaaagaaaatcctatttcctttaagcttcactcgttctcattctcttccagaaacgcctgccccacctctccaaaccgagagaaaaaacgaaatgcggataaaaacgcaccctagcagcagtcctttatacgacacccccgggaggcctgcggggtcggatgattcaagctcacggggacgagcaggagcgctctcgacttttctagagcctcagcgtcctaggactcacctttccctgatcctgcaccgtccctctcctggccccagactctccctcccactgttcacgaagcccaggtgggccgtcggccggggagcggagggggcgcgtggggtgcaggcggcgccaagggcgcgtgcacctgtgggcgcggggcgcgagggcccctcccggcgcgagcgggcgcagttccccggcggcgccgctaggggtctctctcgggtgccgagcggggtgggccggatcagctgactcgcctggctctgagccccgccgccgcgctcgggctccgtcagtttcctcggcagcggtaggcgagagcacgcggaggagcgtgcgcgggggccccgggagacggcggcggtggcggcgcgggcagagcaaggacgcggcggatcccactcgcacagcagcgcactcggtgccccgcgcagggtcgcgatgctgcccggtttggcactgctcctgctggccgcctggacggctcgggcgctggaggtgggtgccgcgcctcggaaggcggggggaggctgcacggtggggacgcgataccccccaagaccttaacccaagtctttaatgcagagaagccgggggtccgtcaatgggacccctctcctctccgcccccgcttgcggacgtccagcgcatccccgctttcggcccagccctgccccagggagtcgcgctccggcccgctgagagggagcgggcgaggcgctggtctccctggttccgcgccagcccggggcgagaagggtagggggcgaccctgagcccagaccccgacttagtccctgccttggaagcgggggtcgggggaggcgagagacattcagacaggggggaagggggaaggagcacgtggggaaaaccgaaaacgcagcgtccctaaagccagtccttcgctcttgaatcgttgccctttcctttctcttgggccctggggaggaggaggaggagtcgggacagcccaggaagctaggagcccctcgcttttccctgcgttctccgcctcgtttcaccttcctctctcacccccatcccccttccttgctccaacctcttttcgcggctgctggcggcggcagcctgggtgcgaccctagcccgagccggcgtcggggtcgcgcaccgccttccacaggcaaactttgtgcatgtccgcgtctcccttttgtgtaacttgcgagaaatgggaggggtcggagacccatagccaccccgcgccttccccaagtctggacgtcccgggagttcgctcgcaccctaagctctgtctgagaggcagaaggtccgcgggaacaaaagccgcgacaccccgccctcgccgtgggccgagccgcgttagtctcagtgcgccaccgaggctcccgcccggctcccttcccggggctgcgcgtccgcctgggagggggcagagacgctgccggggcttctggcggagcctcggggcccctctgcttcccaccctcggatcacctccgaggcttaattctgtgctgggctgtaaagtccttggcggggaggaaataaggcggagagtgggatgtgcgtctggaaagggcagtggcggatggtggggaggcacgggctctgtcctgtgcatccaaggaggcgtttgtctgattaaggcgcggcctcttccctggcagctctggggactctggtttagttcccctgggggcacaggatgctggggagggtccgaagggtcttttttttagggtgcagataaaaggatcgaattgagtgaagattaagacggagaagatggcgcctctgcagtgcagcaaagaaaagctgtgtggaggctgcagcctagtgaaatccacccaccactaggtgtataacaagtcttccccattcatccaactctcgaacattcagctaacgcctgtgcacaatgactgtttttctttacatctgaagatgcttagaagttgtttgcatgacagttgggccagaggaggctgtatttcacttcggacttcggttgggttcctgtttggcatcttaacatttgcaaccttccttacccgtttttcccctcttttcccccagcctcctagtaattttccaaaagaaaaaaagcaatttccgggcagatgttttcctgtaattccactgaggctgtacagactatcacaccattagttttttagtttctaatttgcaaggtcattgaacttttttctcttctgatttttacccacaagtggctcaggaatcaccttagggctagttaagacaggttgttttaagagttaaagaatttcgttttccatgttttaaaaaaatgcacttaactaagagaattctgatttctctcatgacttacttacatttatttgtagaattattccagttttcccgaatggtcttactacagattaaaaaccatacatttaaggaattaaaagcatatgataaccgtatttttgaagcttttgtcaaaacttaaatatgtaactttgttgagcaatatttctttctgtataaaaagaggaagcatgtaggcagattcgaatttagtttttggtctgtttaattgcattaatatgctctttctgccatcttttgggaccttttcagtagctattgttaactcctttaaagggtggaggtgagattcacattatgccattttgcgaagtgttggtagaagggtaggtaattcagtctactgaggtttgagggtggtttatctggttctctctgtgtccactgaaaagatgtaattacgagttgactgtcttttatagagcttagaaaataggtctgctgcaggtggctgtagaaaagaaatgaataagggcaatgataatggggccttggctatcgggggaaacatggttattatctgggttgatgattttggctggtatgttgatagaggtgtgagtttaacaaaccctaatctatatgatgtttcactaccctaatatttatttatttatttatttttaaatctagcttcctcttaagttttatttccctctgttgagggtttaacctagtcacaatcatcttacctttgtggtagtgctaatttatagtttatggaaacctgctgctactgactagtacctcgctaaaggtagaagccgacacacagaatagtaaagctcaggtttgatggtgatctgtaaggagtcacggttcttgctaatcgatgagaaaccatgataactggcagactgcagaagcttttctcttgtcaccggaaccagcagaggctcctgaacgacatttgcaaggctattagtactgcggagaagttactagatggaataatactggtcctgactgaggaaatgaaaaggaacatgcaagttcacgaggttaaatgaggaatggctgattcaaaaaaattaaaaagaaataacgtgatcaacaatattggtttgaaggaatgggagaggttgtctttatgttaagtcttgttgctagaggatctctattttatgttactgttttttgcatactagagtcttctacagatatttgtatgaatgttgtcagtcattctggaaataagcatagctattacttgcatttcacgtggccactaaactatcagtgagaagtgcattaaattcagtagaaatgtacattgtttctgcaaattgtattaccttgagaatcttacaaagcatctttcattaatacatttcttttaaaatctctatcaattacaaatgtaaagataaacctgtacagatgcattttaaatttaaagcttccagaatgtaaggtttagttcgactgcatacctcattacctccccttccctcctccctccccttactcccaggaagtttgcagggtaaataaaacatgcacatgataataaaacaaagtggaatgtactaaaataccaaaaggaaaatacagattaggtatactgagtaaatatgttacagagaaaacttcctgtatttaaaaagtaaggaacaatgggatgagatcatagataatcctggagcatttcctggtagtaaatttccagccaggtttatatcccaggtctggggattggaggttaagtttctgcatatacaatatttgtttacattcctctctgcctctaccagacagacagacagacacacacacacacacacacacacaccctctgtctctttctctctctttctctctctctctctctctctctctctctctctcacttgagtgacagatgctggtgcagggtattctcaacaggagtagggaatttgaaataaggagttgagaggtcaaaggtaaggggctgaatgcaggaccagagagcttcagtagcatcttgatgggcagagtatgagatgaacagtggcaacgaggaggatagggaaaaatcacattttctgtttgtgttttgtttttgtctggtggttttcaacctctctctgtttcacttgactatgcttgattatgaaatcttttttttttctttttttaatttaaagatctcaactggctttgttgtgattctacattcaggcaacactattctgtaaaatagtataaatgttccgatgagttgaacagaggagattggctttgtagacagaaaagggctgaagaaaacagaaataaaaaaatcttttccttttcatagtgagagctcagatgcaaatgtatggagtggggatggatgggaaatgccgtcttttgcaaacccttggaaacgctgtcaccctgtgggtctcacagccagtgtacagataacaccctcatctgtacacagaagacagaaggtggcaggggaaggaatgagcacaccccagaatgagtagcaagtttaatcaataaaatatgtatttctttttttattgttgtataagaagaaaagcagacagaactcaaaccctgaagctgattttgcaagtgaaaagcttagtaaagggggaaatgttatgtaactattttttcagtttagtgtggatggcttaagaaataatcattactgtgaggacactagtatttttcttggaaaaaaaagtttggcaaattttcctctttagattaatcttggttatagattattattatgcttgagtggtacctcttcagaagtagaaatctggcaaaaactggagtacaatgattgctctaggaataaattcacatatttaaatttaaaagcctggatatgtgcatcaattaatagctttatgaaacagggatgcttagtagattagctagctgagtattcagagagggccacagaagtctcaggttcacatgtattaaatctgctgaaatagaaacctaagagatcattttatttaggtttattttgtgtggctacatgttgaagaaacatgcaatagagatttagcttgaaccttgcgagactcacagtatcttacgaaagaagatagttaaaatggggaagatgagaggtttttaaaaatgtcacctctgtagaacgaaccagagttgttctcaatttataatgttgaatttgatgccaggcgtgatgttaggccaataacactgagtcattgagtgtttctcaggtatgtagagaaggcagcattgcacactaatcaggagagtttagaccagggcaggaatgcatgggcataaattctgtctttgtttcttttgagctagtgaccatgggcaagtttctgtgcctcagttttttcctttgtaaaatgggatgagtacttctagttattgaggatcgaattaatatctttgttaaatgcttgaaacagtgtgtgagttaatatatatgtaacctgatggcatagcataagcactgtgtgttagttgctgctatgtatggtgatgatgttgatgtacaatgggtatatgtaagtttcctgcatagttgaaagttaaaaatctagatgatgtttcacttattgacaaattacttattggccaattaagactattgcaggaaattgacagattgttgtctatgagtttgatctaaatttaaaaagcacatggtatctcagatacaatttttagaatacatgttataaaatttcatttattaaatatgtattgtgtatttcaattggttttttgaaaaatgaaaataattcatgctcattgaaaaatttaaaacagtacagaaatgtgcaaaaagcataagcattttttacacaaatgggaaatacctagtttttttttttctttttttccacataacatggatgtagaccttttttttttttttttgagacagaatctccctctgtcacccaggctggagtgcagtggcgcgatctcggctcactgcaacctccgcctcctgggttcaagcgattctcctgcctcagcctcctgagtagctgggactatgggcactcgccaccatgcccagctaatttttgtattttttaagtagagatggggtttcaccatgttggccaggctggtctcaaactcctgacctcaagtgatctgcccacctcggcctcccagagacctattttttaatgttgtacacactggcagcttgccacagatgtctaatattgagcaagtttatacactggcttgattattaactattagttggctatcagctatgtgcaaggaactgtgaacagacttggtttagttttcagtagaatctttgctagcaaaacgaataaacaggctttgccaatctgggtagaaatggaagatttcaaatgccagcaaaagaattttggtcctaatatggaagcttgaagttatgttcacccaaggacagggaaaccaaaaagcagattgcttgagaatgcggcatttctctaggaaatcagtttcaaaataaaatgaattttttgttttgttttgtttttgagacggagtctcgccctgtcgcccaagctggaatgcagtggtgcgatctcagctcactgcaatctccgcctctcaggttcaagcgattctcctgcctcagcctcccgagtagctgggattacaggcgtgtgccactatgcccagctaatttttatatttttagtagagacggggtttcactatgttggtcaggctggtctcaaactcttgacctcgtgatccgcctgcctcggcctcccaaagtgctgcgattacaggcgtgagccaccgcgcccagctgcagtaaagtgaatttgtgtaaccagccatgttatggctgttacatctttaaaactttatagtgatctgctgtttaattgaaattatatattttttttaaaaatcagcatatgttgctcaaaaataaaaggtttttagcttcaaaagcaggccaaggatatttgaaagccttgagtgtatgaaactggtgatactgtggttaaatgatgatgaacgcagggaaaaatcaagaagcagagtcccaaagaattcacatgggtttttgttaaccagctcatgtaattataattgtcctgtccaactaaagacaagaagacaagaagtgggttcacatacgaggatgtgtaatgacagaagccatatttgtgataaacatcctgattacagtagatacagtgaggagtgattaagatggttccagaagcaggagtggagggttcatgagcagggatgaggaataaataggacaaacattttggaaaagggaaaagatgaataagcctgttttgtaaattaatggatcctgatgaatgaagtgcagtgattccttaaggtcttattaatgatggaccccaaacagtgtttgaatctcttaatttccagatggttcctttttttcttcacaaagtcagaaggttttcttatgagaaatttgattcaacaagaataattgtcacttcttttgttttttggtgatttttttttttttttttttttttttttttgagactgagttttactgtgtcacccaggctggagtgcagtggcgtgtcttggcttactgcaacctctgcctcccgggttcaagcaattctcatgcctcagcctcctgaatagctgggtttacaggcatgtgccaccacgcctggctaatttttgtttttgttttttttttttttagtagagacagggtttcactacattggccagggtggtctcgaactcctgacttcaagtgatccacccacctaggcctcccaaagtgctgggataacaggtgtgagccactgcacctggccaattttttggtgattttgataggaatttttttttttgcctgatgctttttttgagagaatctaataatttgtctcttatttaataatttggctttcattagcttccagaaagccacatactgtcttcattgaaaaatgtaaggcatcctagatgatacagactgataaattacttttcagccataaaagatacttatgagaataagagatctgttgcataaagaaaagtcatttgtgttaagtgaagaaatgcattattactcttgctgctttgctaaatttcaaacattgaataactaatatattttgaccccctggagatattttacaggaagaaaaatgagaggtttaatcctactgttgagatagacttaacgtgttttagacctgcccctcatcccaagttactacaaactcatttgtttagtttttccttgtctgtgtgctcgttatttcacagtaaaattagtgaggcaacataaattttatttttaagagaaagtaaagaaaatggctttatccattaaaggtttattcatcttaaaaaaggacttgttatatctactcctactattggatgaattttcaaaagcatattgatactgtgtttggttttgtttgttttcgggacaagtcctcactctgtcacccaggctgaagtgcagtggtgtgatctgtagccgtggcctcctgggctgaagccatcttcctgccccagcctccagagtagctgggactacaggcatgtgccaccacatctgactaatttcttaaatgttttgtagagatggggtccccactatgttgcccaggctgatcttgaactcctgggctcaagcgatcctcctgcctcgaccttccaaagtgctagattacaggtgtgagctattgtgcctggccaatgttgtttttataaatatcattactcagttattttgtttataattgaattgataggctcatagaataaagatggataagcactgtttcttaactgtatttattgatttttttatctttcaaaaaaaaaatcctcatctacttcaaagattaagcctttaaaaccgatgcaaagtttttgaagtcttagcttaagtcttcagagactaacattaaaacccatcatatgaaaagtgatatgtagtagcaaatattctccatcctgatgctctcaattgcttattatggtttaacacaaatataattttgtcattacagtaaattagtttgaggatataactgaagagtacctaagaaactcccatagaaatgtgaaaatatgcagactaattattctaagaataattaatcatagatacttacatattaaattgattagcaatttaaaattaaagccaaatttctgtggaaattagcttattttcatacacaaagaaacctagattcttaggggtacaaccaagaaagggccactccttcatttcacaaatattttcgaggtccttgcccccaagagggtagacagaataaaaaggaggaaggaagtgacttggaaaaaattaagttgggtaaggaatataagagaatgctacgtagaaggatgtgtgttgtgaatgcaatagtttctgtagtattgtcaaagttctctgatcatttcagtatgtgaaggtaaacttagataactgggggaaggaactatatatttactacattgtaaaagaataattgtagacagaagatctactttgggtgattaaatgttgaaaacaagtggtgggagagagaagttagtgttgattgtgatcacacacttttctatacagtaatttgtttgatcactcatgataatgccttacattttgtatgtactaaataaatgagttctctagaaattctatgttgtggtgataaagaattacgttcagattgaagattcgaacagctgtgcaaccttctcaacatttaagaaactgcgaacaagcatagaaagaagattaaagccttttaaataagattcttttttttcagcctctttttggaacattttattgtgaaaaggtttcataaatactgtcaatacatcacgttcagtcatttgcaattgtatttcaaaaattcagttggcctgcaaaaagaaaaaatgcctcatttttgaaatatttcatccatgccctgattgattgggacactttcaatagagggtgcctagacataattttgtgtgaagaagttagtagagtttggaaagaaaatgtgtattggaattaaatttagtggcatgaaaatgaaaatttctctgtcattgtctttttttttggctccttttttggccattttacagctagtgtttagtgtgacaaggatcaaaattggccctttaaaaaaatatattgaattctattacctctgttatctaaaagaattgtatttttcaatttgaagagcttgaagccaatactactatataccattaacttgacaggaattgaaaatctaattgaggtcattatgattagccttgtatcttgctagtattttctcaatcttattttgaatgttttgtgtcaagtgttaaatcctcttataccacagaatccagaaaatttaaatgcaacagaagtaaaacgaatataaaaattctatggttgttgtggaggggcgttcttggctaacccatagggtgtttgaatgtaaaggcagcttacagaactgctgctagttgaattgtggagggtttcacttttaagagtacatttgagacaaaattgcaattttggaatcacttattcctgcttgttcagtgaaataggagaggggggaattcctgagggaagctgggagatttccaggtgatgatagagtagccatgtgagtatttggctgaaacagagtagaagccacctctgtctgttggacagaggtggccttaacactgagtatcaatcagcatggccattagagctgtccaggacaaacataatgaatgttgtggtggcagagagggtatacttaaatgaacaaaattggaggctgactttccttgtttcttggtagttcctttcttcgtatttgctatttggatatttcacttcacttttgtgagctagactcaaaggttaaatttatatcattgtgaattttctgggtcatattgtagggacacagatgggaagcatcccttcagtttattgagagtatttcttatgcgcatgtgtttttaattgtatttattgatttaataaatagccgatgagatgagaaaaaaatattagtgtcttgttgttgcagagaaaaagacattggatgcattcttagaatttattatcacatgcgaagttatttagatttacaaagcaatctgacatgttgacttcattgctcgtttgctcatttctatcagaggttgaacacaaagccaagcctaagcccgtgattcttctgtgtgcagatgagggggaaggtttaatgcagaatgtttagctgaatatttggattgtgcattccccttttatgtctctactgcaagttttctcagggcatttgtgattgacttctgtgatgttgacatttatttggagttagatgtttaaaaaattactaatttatggcctggtgcggtggcttacacctgtaatcccagcactttgggaggccaaggcgggtggatcacgaggtcaggagatccagtccatcctggctaacatggtgaaaccctgtctccactaaaaatacaacaaattaaccgggcgtggtgacaggcacctgtagtcccagctactcgggaggctgaggcaggagaatggtgtgaacctgggaggcagagcttgcagtgagccatcgtgccactgcactccagcctaggcaacagagcgagactccgtctcaaaaaaaaaaaaaatttactatcttattgtttctctcattttgaatttgtgaaattattattcattttatggacatactgcatggattctgtgtttcagttatgacaggagatctagaatctgggtggggctgtgagtaaatagaaaggtaactcagtctgtgccttgaggaattccgcagtccagtggaggaagaaagagacggagaaataattaggtacagtgtgccaaaggctataatagaggaggtacaaactcttcccagagaaggcaggcagaatttgaactaggtttcaaggatgtgtgaaggtgaactggggtggggagggcttcccagacagaaaaaacagcgagggtgtagagtttcaaagggggaagcccaggggtataataagtgaaggagacagtgtgaaattataaattttggatgcccttaatgagtttgaacttcattttcttagaaatggagtacttttaaatgttcctaaaatggggacgaggcattgatattcatggttcagttaggtttaggagcttttgtagaagtccttttcaaggtctgcttaatctcatgggccagatagtgacacctcgatgcaagggagcatgtaaatgtgctctattagctgggagcattgctatcagaaattacatttccggctctcttcttaagggtaaaggagaggtaggatattgagtggcaactggcattctgggatgtagaagaaatacagtaccataaagggatagaggaaaatgggtagacttaacgttctgaaccaaagctaagattctccgtgagcgattagagtaggcttttgggatttgcttaccttctcttatctgctagccagccacacaggaagcacatctttgtggagtgacagaggaggaggtaggaaatgctttctcatttttatggtagaaacatccaagagctgagccttcattctggctgagagaactctagatggttcagacttgcattcctgggaaggccttccagctagagtgatggaacaaagcaatgatttctgtggccctgtgtggacagcagtggcagtcagtttactctccctgttggttaactgtctttcgtttgatctagagacttcctcaaaacaattttgttgtgcttgttctttgaaagcaacagcagacaaaacaagctttgaggtttttagaaaagagcttgacactgagcacctcttttgagctagatctgtctgtcatgctgaacctgttttctgtggctgcgtagcttttcaaatctgtttatgcttgctggtgttattgaaacagaatgggaagatctatgcaaaaaggaacattgatcttaataaatttatgtcagtaagaatgggactgccattttaaaatttattttaattccttacctattttcttgttcaattattctaaaagtgattaaatgaagatacgtcacagaaagtatgctttgaaatcaagatgtggggaaaacctgtagttctgagtaggcctgatagaatcatcattgttagagtatttggaggttttgtagtagggattttgtcttcacttaaatatttagttgaaatatgttccaatagtttgacacattacagaatctgtctgaaagaaatgtctaaaatatgattcctcagaagctgctcttggttttactttctgctgttggttttactttctaacatttcattttgatcccgcagttttaagagtaatcaaaaaggccgggcacggtggctcacacctgtaatcccagcacttcgggagactgaggtgggtggatcacttgaggtcaggagttcaaggccagcctggccaacatggtgaaaccccgtctctacaaaaaatacaaaaatcagccgagcgtggtggtgcatgcctgtagtctcagttactcgggaggctgagacaggagaatcccttgaacccaggaggcggaggttgcagtgagccgagatcataccactgcattccagcctgggcaacagagccagactctgtctcaaaaaaaaagagtaatcaaaaagctacattatttaaatcttggcatgtctttaaaaaatgttaaactgtcaggaaaattatcacttctggataccaccttcagaaaaacacatgaaaatttgtgcatgtctcaaatagttgttaatttatgaaaaattagaaagagtgtttgaatgtatatttctgtcatattatattgctcatatttttaaattatactttttttcacccgtgaagcccatatagttaagtttgaaaattttaattatattagaatttgaaaattaaataaatctcctttaattcatgcataattttctaatagtcatatagtttgtattatataatttgagaaacttggttctaaaaaaattgtctgccaaagaatgtatatttctgaattctgttctgctttcatacatctgaaaatatttgagctatcataactggctatgcttcaaacccagtctgaaatgggtgacctttgctggctttggattgcagagctgggggctgttgtttgctttatctgatttaaaatagtcagtagtttattttgcaggcagttagatgtatacctttgcataaaatcattgaactgaaaaggttggcactccaagaatacgttgtgagaaaagagaacttgagtactcactctcgactcacctgaatcttattaatattttattgattaatatctgttgtatttttaagtaaataagctctctagaaactatctctgcttctttgttcatttaacatatattaaacaaattgatacagattgcaaaaattagttgcaacgttcctagttagatatcaatgaaataaaaatggtctattcatacgagttcattttagttattcctactaatatcaaatgtgttttaaaaaatgggagattataatctttttatgaagtaagataaattattactttgtatatttaattcaaagaaaacaaaaaggccacaagtgcctgcataaaggcacatccacttaggattattgttaaggcctacagttgataattaggattcaggcatagcataaatgaagtggtatctttttttttttttttttttttgagacgaagtctcgctctgttgtccaggctggagtgcagtggcacggtctcggctcactgcaagctctgcctccctcctgggttcacgccattctcctccctcagcctcccgagtagctgggactacaggcttccgccaccactcccagctacgtttttttgtatttttggtagagacagggtttcaccatgttagccaggatggtcttgatctcctgacctcatgatccacccgtctcggcctcccaaagtgctgggattacaggcatgagccaccgcgcccagccagatatcaattatttttagacccaatgatatttgctgttgatttattgttggtgcacaaaataagaaaacaaaagcatggttttaaaacagccctttacacatttaatatggaaatggtaacctacaggtctgtattccatacagattcctgggctcattttatctgtgaattcctctgggcgtcatgcatgcccaggactgactttaaagcagaattatccagtagaggtataataggaccgttagatctaatttaaagttttcaagtagccacataaaaaaataagcaggcgaaattaattttagtctgtcactaaattcaaaatgttatttcaacagggggtcaatataaaagctatttatgaaatacattattttttcatattatgtcttcaaaatgttcacatttcacatatttattttttattttattattactatttttttgagacggagtctcactcagtcggttgcccaggctagagtgcaatctagcttgctcattgcaatcttggctcattgcaacctccacctcctgggttcaagcagttttcctgcctcagcctcctgagtagctgggattacaggcgtgtgccatcacacccagctaatttttttatttttggtagggatgagatttcaccatgttggccaggctggtcttgaactcctgacctcaagtgacttgccgctttggcctcccaaagtgccgggattacagttgtgagccaccgcacctgattacatatttcacatattttaattcagaccagctgcatgtcaagtacttagtagccacagatggctagtggttactgtattggacagtgcagctctaggagagtctcttcaacctgcagctgtctaggaagagaatcatagtttctggaacaggtagaatctataagacctcctttttaagcttctccactttacagatgaagaaagtaatatctggagatgttgagttgttcaaaatcacccacattttaaggatcaagagcccagtccctgttctctaacttctaatctctttcttcatcactttttctgcttcatgttgctgcatcccctttagttactaaggtactaacgttaggttgttgctatcagttaaatattaagccaggagctttaagacaatctggcccacttgaaggcatggcctgatttggacaaaacttgtggggtaggatgaatagagttaccaggcatatcttcaacctctctgtggactagtattatacatatatgagatgatgtagggtccagtgatcagttcatctttttctattgtgagcactgttggaataggaatggggggaccttttgggacccaggatatgtgattctgaaccctgaaatgtcagatgcccactaaaaggaaggggagagatggacctgtcattaccttacacattttattgtctgtatgggtatgtaaacatgtacagattataaggaattgcacttcatttctgggcttctggaaacacaggtattaagatttcatttacctccccttgttttggaaggcttattgtgtgtgtgcccatagttcttacccagttacacttaaagtatgatactttttgacagcttaagcctattgcattcctggcatgtaaaatagttattttcagaatgtaagcaaatgtggaaagcttactgcctgacatggagggttggagaagtgggattggtgttcttttgttgtaaactcatttttgtgaaatatttgctttacaacgtgaagcatgcatgatggatgaacttttagaattgaaagttatttttcatttcattcctgaaatatttaccagcatggatgttgactgagtgctttgaagagtttgcttagtcatataacttaggttttatgattttagatttaattaaacttaaagttttcctgtttgatcctcaggacttctcatctgtggcaaggctttactcacaaaggaaatatcaaccttgaagttaagcatgccctgtgtttctttatattctgatgaaaacgattgaagtttgccagtgctgtgtctgggacaatgcttagaggattcatggcttgtaggaatgagttaaaagtacaaggatattggctggcatggtgactgtcgcctgtagtcccaaaactttgagagtctgaggtcagaggattgcttgagctcaggagtttgagacaagcctgggcagcataaggagatcccatctctatgttttttaaaaaagtgaaaaacaacaacaacaacaaggtacaggggtatctgcgtttccttaggcagctgtcttatatacctttaaccttaaaaaaatccaccatttttaaaacagtgttttctgttgtttttcttagtaaatataaacaataggaactgaagtttagggcttaaaatttttgagagaataatttttatttcagtagcttttggggtacaagtggtttcttgttacttagttgaattacgtagtggtgaattctgagattttagtgcacttaagtagggtaccttgtacctaatgtctagtttttcttttaatccctagtcccctattaccctcctcctcgtgagtctctaaagtccaatatgtccctctgtgtgcctttgcttattcctaacttagttcccacttataagagagaacatacggtttttggttttccaattcctgaattactttacttagaataatggcctccagctctatccaagttgttgcaaaagacattattttgttccttgtaatggctgagtagtagtccctgatgtatatatgccacatcttctttatcctctcattagtcagtggccacttaggttggttctgcatctttgcatttgtgaattgtggtcctgtaaacatatgtgtacaagtgtctttttcatacaatgacttcttttcctccgggtagatacccagtattaagattgctggatcaaatggtagatctacttttaactctttaggaaatctccataatgttttccatagaggtggtactagtttacattctgagagaataatttttgtaaaattatgtttaagctagatttggaattgggaaagaattacattctttataggaagcttttgaaaaatatatttaaaaatatataaaaatatgcataatcctaccacccacaaatgtctgtattattatgtcatttctaaaccatttttgagattatgctatagattacgttttagatcctacattttatttcttaacattaaatctcatactattttaagttctttgtacatgtaatgtttactgaatgggtaaatctgtttagggaaactggagctatgtagttgtggacttgtgcttttgttttgttttgttttgtttgtttgtacatttgctttttagaaatgtctattcagatccttggcccatttttttttttttttttttttttgagatggagtcttgctctgtcgcccagactggagtgcagtggcgcgatctcggctcactgcaagctccgcctcccgggttcacgccattctcccgcctcagcctcccgagtagctgggactacgggcgcccgccaccacgcccggctaattttgtttttgttttgtatttttagtagagatagggtttcaccatgttggccaggatggtcttgatctcctgacctcgtgatccccccgcctcggcctcccaaagtgctgggattacaggcgtgagccaccgtgcccagacagacatgtgcttttttatttggcatttctagcctgaacataggctggaagtagtgacttagagagggattgtttgccaaatatcaggtaatattttaattatttattatttattgtaatgctgtgaatcaggagtccctaacccctgggccatggactggtaccggtctgtggcgtgttaggagctttgctgcacagcagtaggtgagcaatgggtgagtgagtgttgctgcctgagccctgcctcttgtcacatcagcagggcattagatgctcataggagcgcaaaccctattgtgaaccgcatgtaagaaagtgagagctgcgttgcacactccttattagaatctaatgcctgatgatctgaggtggagcagtttcatcccgaaaccaaaccacaaaattgtctttcatcaaaccattccctggtgccagaaaggctggggaccactgctataaattgctgctgtcaagtagtgttacgcatggtggtctttaacataaaaaaaaaaggtaatgaacgtacaccacacagattagcaaaaataaggaaaggctgatctagtagttcaaacaagcaatcctcttatttaatggttctgtgattgctcgtgtaggcagaagcttaactgtaagttgttgcatttgacaggcaaatgtagctggagctggaatgtagatattagtgaaattgtgatttcagtttactggagccattcagtgggagcatgaagtgggttacatgattacacggatataaataaagcgtcctccttgccacttcactgctgttaaagtctctcctgatgttatgtggtgaaaaacaagtcaaaaacattaattctgtcaagtttccaaagatataagaatctttgaccagaaaagagacggtatttatcttcaaatttaacaaattgtgatgaaatgctgctgttacagaacctagtgtaaggtcgtggagtccattcagccagacacatgtaattttgattattaactgccgtttctgtggtcagtcggccagttttatatatttcacattataggtatttggagcaaagacagtgttgtttattgtttactttaaaaaaatacaatactgtaactacataatgagtaaatgttgatactgttgaaaactaataaaaacaaattcttacactatcaacatcacagaaattctaattgtaagaaaatattgatataatatggaaatccgttcatttatttggtgcattaattgaacaccaacactatgccaagcattgggatacaaccatgaaagaggccagcttcctgatctcacagagcttgtactttgttgggtggggcagagagcaaatcagtcaatctgtctgtctgtctgtctatctatctatctatctatctatctatctatctatctgtctatctagatgtcaatcagtatactctgtgccacttggtggtcagtgctatgaagaaaaattaagccagtgaggagctggatagagacacagtctggaagggtatgaaggggatcagagtatgctacccccaaatatgccatttcagcaaagtactaatttgagctgaagacaatcgagaaatagcagacccaggacaagctttaccccctttttataaaaattttgctgtgtgaaggtatcctccttcccctctccatccctggagagaccactagaggtggcaccatcgcctgcagaaacaaaccttattgaaataacccttatcttctattagtttcccccatatatttaccttaccacacttcccctggaagccctaatcccctctcctttgtcttgtgacttctccacagtttattgctctttgttaaaatggtgtgtatgctctcaggcctaactgcttcttttgggtttttgcttttctgtggagctccctcctctcccctccctcatgtaaaaataataacattaaataaaatttgtgttttttcccctgcgaatctgtctcgtcagtttaattggcaaggcctcatgtgctgaacctaacagggtagagaaaaaaggtttttttccccttttctacaagtattaaacctggagagaacaatacagtgtaaaggctgtgaggtgggagcatgctggggtgttggaagaagcacatgagcttacaaacattccatcaatttgcattcattccaaaaattgtatgcaatttttcagtgacgattcccattgatcaatcatttataaaaactaatggtgagggtcttccatactcagtttactcccttcttggaaaagaatgtacattttaatcaagatgatttcatgaaagacattctgtactccaaacatttaaaagagcgtttagagtatacagcaattcatcttttcttctgtattttaaaatttaagacagggagaattattgtattatacttagttcagatttggtggtggttttgttttttggttccagtgaaaagaaattgcatcagtaacctggcggtcaaccgtgccatattgtttgtgatttattagtctggaaaaaataactgtatttctggcatatgtaaaaatagtttgctgagaggcctccttggttgtggcaatagtaatactaattaccaggtactgtatgtagctcattctatgaaccaggccttgttgaaaagtgctttcacttaattttttcttttcagcagcctgtgaggtacctactgttatccccagctgggagggagctggccagtggactgggtttaaactatgttttcattgtctttactcttaaccacttatcttctctgcctccagcaaaataagtcaaagagttcagccagtgtttcttcttggactaagcagtcagcctcctaagtaagcaagccttggaatgcaattgattggtaagatactaaagtaatcagtaaggccctcagttcctggctgccagcttctttcaccctctcctgcaggaagttctgaatgctgatatctctacttggtgtcttctctccccctcccaattccattatttccctttttctcaatcccaagtgaaggaagttctgagtgtggatgttggagtcattcagaccttggatctgagtcacaactctttcaatttactagaaatatgactgcaagaaaatgatgtaagcttccctaaaccaatttccacatctacaaagtatctaaatagattgcttaggagaaaaattgaattaaattgaataaagtgcaaagcacagaacatggccaggagtaggccctggatgaatgagggaaaaatggttctgatttttatttttgagcctctttgtaacatttgttggccccttcagaataatccttagagttcatatcagccacccttcatccctcctgggatgggccaggggagaggcccagttgcctgtgacactgcttcgtttcacatttcactgctttagcatctcaacatttcattgataacatttttgatgcctgaaaacagaataacttatttgtaattctacatacattttgtttgtgatcaagttgttagagtttgaaatgagcctcatttccttgggttttgtccctccccatctgaccttcctcttctcagtgaaccctgaagaaaaaacactagcaaaggaatctcaagaatgttggttcgggacacagctctctccatctactctcctgccctagtcctgcccctccttgtgttttcagcggtgaccaggcactggtgacagccttggctgcttggaccagctggaggtagctgcaaaatgcctgcctgctagctttgaaaaatctctgccaacctcattgaaataattgtttaccacatatcagaggggactgggaagtgggtaattgagagatctttttgaaggggtttgtggcttctccacttgcagaggcttcctgaaatggtgggtaatgctcatgcctcagggagaatcaatatccttctcctaaaacctgctcacacgtagctctaagtattagacatgcatttttgttaacattttatcagtgcatttttctacctgtgtcatttggaccttagattcgggagaaaatcactgtgtatctttggtggtttcaggtggctcttaaatttcattaattcacaaaatctgaattgaatggaatagtctgttttgggaggtttttttgggggggttggggagggattggatttttcagtccttccaagagacttcaggttttttttttgatgttctgattagcccggtgtgtgtaaggccctatcaggtgttcgcctgtgtgatcctatcacacccacatcctgtagctgcatccaagtgctttgaggccgacttaatggggattaacttaacagttgctctgtgggaacagatgctctttgccgcttatttctaataaattgattgagccatttaaaagattttttttttcttttaagttacatcttcttaagaaactgtagacaataaagcaaaactaaaatacttgggtctaaaattagtgtattatatttaaaacactgggcttcagactgattatatcatgctcttttactgactttctagtcagatgcttatttataaaaataaagcttatataaagggcagcattcaaatgttacaccagtcggttttagcagtttgaccttccacagtagctaaatattttttacactgagagaagaattctttaacattatatgctatcagcatgtcaagtgaattctgagcttgcatgcaacagatgagaccctaggtggaaacataaaaacataccagtgtgaaagagaaaagcaggctctctgtctttgggaaggagttctgcagggaggggtgtttataagtgtagtagatacttaggaaaattaatacaattattataaaagtcatctgggaaaaaccattaggtaagaatagccaataaaaaaccagaagcaaaatgtaaagatatagaaattaaaactgcacatcccatgcatagataggtcaatggggcaaactggaagtctagaaataaagttgtgcatatattggaaattagtgcaagataaaagtgtctttttacatcagaaaggggaaagatggattatttagttaatggtgttgggttatctgactgtacatagaaggaaggtgggtaattatttacccagtaccaatactggattacctagtattatgtacccagtacagtttgtcagcaacaaaaggcaaacttttttattccatgaagtgttcttacaaatcagtaagaaatactaaatatgaacatcttcagagaaaaatgaacatttttgaaaacttattatgaaaagaattaaacatacacaagagagaatagtgcgctgaatgctcagcaatgatcagctctcacccagtcttgttttatctgtattcccctttctcaacctgctcaattctcttttccctcactgggttattttgaaataatttcaattctataattttatgtataaatatttcagtgtggatgtctaacagaatctctattagacgtggacaaaaaaggcaaagaattttatagtacacaggaaaaaatacacagccaataaacctatgaagatatgctcaatctcatagtcgtcagggaaatgcaaagtaaaacagtgatataacattgttttttaaaaccctgatgggcaaagactaaaaaggcttgccagattggcattttcatctactgtcaattgataacagatatttctttgcttggagtacagtggcacagtctggactcactgcaacctctgcctcccaggttcaagtgattctcctgcctcagcctcccgagtacctgggattacaggtgtgagccaccacgcctggctcattttttgtatttttagtagaagcagggtttcaccatgttggccaggctggtctcgaattcctgacctcaagtgatctgcccactgcaggcatgagccgctgcatgcagctggtacagaaattttttagatcagtcatttagaattttatgtacatatcccttgatctaggaattctagaaactaattagttcatagtatattgtataaatgcgcacagatgaggatattatgagagcattatttgtatcaactaagcaagcctttaaaaaactcttatacagtagaatattatgctgatacattaaaagtgggcataaccatactgatgtatagaaatatctaaaatcataccgatataagtgaaaacattcagaatgcaggcataatcacagattaaacagtaatttatataaaaaacagaaaatttatatgtgtattatgtcagtagcagattcaagtgaatctgacaaaatctgactctgggcaatgagaacattggaatggaggagaaggtagtacatatttactttgtatattatcaccttttgtactatttgagtctttttaactgtacgcagatactttagagcaggggtccccaacacccagccatggacaggtactggtccatggcctgctaggaaccgggccacacagcaggaggtgagtggcaggcaggtgagccagtgagcattactgcctgagtgctgcttcctggcagtagattctcacaggagcacaaaacctattgtgaactaaacatgggagggatccaggttgcctggtccagtccttgtgagaatctaactaatgtctgatgatctgaggtggaagagtttcatcccaaaaccatcccatcccatccagtctcatgccatcccacccccaacaccccatggataaatggtcttccacaaaaccagtccctggtgccaaaaaggttagagatcactgccttagaggctgctccctcttggcacatcttgaatgtaggactccttggttctgccattcctggtaggtagtcagccagcttttgatagttctccccagagacttcatcccacaggcaagccatcccattccacgtaaaacatctctaatgttaggaaggcacgtattttgatgtgatatctagaatcctcccagctgttcttcagaggaacattacttttataaagttgaaaagaacgttttattgtattataaaactaggtcatttcagtgaatttcatctattttcatgggtaactgattcttatatcaaaacttgcttttgaaagtactggaagcataaattattacttcaggcccatttgctttactttgttcagcacattgaacatcaaggagcaactccctcgatctaaaatttctagcattggtgcttgtaatatcatttttcaagttgacattaatgctatctttggaattctcatggtaagtcagaagaaagcagtttagtggaactgttctttctcccactgaattgtatactgagatctgttatattttctgcattttaacccagaaagttgttcaagagaattgaccatgataagacatctgtagcttattttgtatttttttaatggaaaattgtaactgacttttaaatttaagattgagtgtagcctttcccaaaccaatagctaatgtttttataactatttagtgtaggagattataataaaatccacattgcttaagatataaaatgtttgtgcagtaataggctgtataaaaacagtaaattgagattgtatcaggaataatgtattataaaccatatatgaaaccaggtactaacttggtattctgcatagctttatcagaaaggcagagcaaatactatctcaaaatgaagtataaacaaaatgaggttcagtgagtgatgtggtttggctccatccccacctggatctcatcttgaattgtagtccccataatccccatgtgtagtgggagggaccaggtggagataactgaatcatagaggcggtttcccccatcctgttctggtaatagtgagttagttctcacgagaactgatcactttataagggacttttccccccttttgcttggcacttcttcttcctgccaccatgtgaagaaggacgtgtttgcctccccgtctaccctaattgtaaggttcctgaggcctccccagccatgctgaactgtgagtcagttcaacctgtttcttttataaattactgagtcttggatatgtcttcattagcagcgtgagatcagattaatacagggaggctacataatttgacccaagtagcaataaacaataggggtgaggttgaaatccaggcccctggtacttatggccttaagctaagtgaaataagccagacacagaaaaacaaatactgcatgatttcatttatatgtggaacctaaaacactcaaactcatggaaacaagagtagaagggtggtgttaccagggtttggatgtgggggaagtgaggcgatgttggtcaaagggtgcaaacttgcagttatgagattaatacctaatgtacagcctagtgactagttaataatagtgaattgtacacttgaaaacgtctgcgagagtaaatgttaaatattcttaccacacagaacaaaaaaagtaactctgaggtgatggatatgttaattagcttgattgtgataatcatttcacagtgtatacatatatcaaaacatcacgttgtatacattgaatatacataatttttgtcaattatacttcagtaaagctagggaagaataaaagaagtgacctaaccaggacacctatctgtagctctatggtaaagccaaaagggataataacttttgattatcaaaacttcatcatcattattattttttaagactgggtcttgctatgttacttaggctggtctcaaactcctaggctaagtgatcctcctgccttggcctcccgacatattaggattataggcatgagccatcacacccagccagttttgaaggtatctttattacatttttttgtttaaatatttaatagtaagtgtttaacttgaagcatttttttctgccttaaaattgattttcccactcattttatggatcaaaactattatcagattttaattcccactccaccacattgtttataaaagttgacaattatggaaagtaaagtaatactgaatttttctaatgcctatctttgacatggaataaagattataaaatttcttataacttgaatgagtttttaaaaattggacatctttttataaaaatctagcattgaccatttcaacataagttttacttatctctgaaatacaggtagtacctatttttattaattttcttaagtgatgctgagtgacactatttttgttttttttcactttttctttacgttttttttgagacaggatctcagtctgctgccaaggctagagtgcagtggtgtggtcttagctcactgcagcctcggcttcctgggctcaagcgatgctgccacctcagcctcctgagtagctgggactacaggtttgcaccaccaggcccagcagttttaaagattttttgtagagatggggtcttgctgtgttgcccagactggtcttgaactcctggcctcaggcgagcctccgacctctatctcccaaagtgctggaattatagacatcaaccaccgtgcctggccccagtgacactgtcttaattttgaatagggaagtatctaatggtattaaaatggtctggcagagaaggggatatgaggcttggtgaaaataagcacaggatgcaccatctttgagtaagtgttagtttctgcagtgagccagcagcaacattcttagcagagcctagaaagatcgagtgagggctgtgtggtggtgcagcctcttaagtctctctggttccacaacatgctcagattggtggctttgatattttctccatccaggacgcattgtgctaagcttagggaaggtccagtggatatttaccaagcctcttatactgccccgcatgttgccatgagacagcagcgttatcaccttaaatggtgcaaatactccttgtgcataccctacccctgagatctaacatctggattctggatactgtttcctattcttccatcttgctgcatggttcccaggttatgtatatagtgtggctaggcaccacacatggccctggctccttgcagccatacagaggtgacctaactggatgtaattgggtatgtaccgggtgttggctacctgtgcaggttgagggccttccacaggtctagcaaagcaattcattgcctttctgaatttttgaatgcttcatttgtgaaacccttgatgtaataactgttgatattatttctttttgaaaactccccttactcttccctgtttcttcatttgtaaactggaaccgatagaaaagtaccaaacttagggttgttgtgaggcgtaaaagaaataatacagcccagagaacatagtatatactcagcaagtatttattaatatgactactaagccagcattggtgattgattggctcatagtgtcttctatttgccagatgttttcagaggctctgttcatgttcatacccatgtttgtaaatgacagaatgtaaatttcttaatcctctgtcttctcctttagcatcagctcttgtccccaaagtaaaagaactcagtcatccagaacccagttttgtagatctatttttcaaaattgggcagttaatagaaaattaaaagcagtctagggaaaagcctttcctttgggtttgttgctttcttttctgtcataataagactgtgcccaaactgtagggaaaaatcaagaaactgtaaaatacatcatcagggtgtttatagtaaatgtaaaacgttaagtaacatttgagttaatctgtgcttgtacaaacctcagaagcttaaataatgaaccaatgacatataatttagaaagttttcattagactctttgcgttggtatttgcaatatcagatttgcatgtcatcattattagccttcctctattttgagtgttgactaggtgccaggcgtcatgttgagaaatttatgtgcttatttaattctcacactgactccatgagatagatactccattttacagatgaggaccccacatcataaccttttggccagaattacagttagtgttagaatttaaacctatgcagtctcattccaaatcctctgtctttactcctccagaatgctccattaaatgaattgtttcttataatccggttgttttaacgttggaaaagaacttgagaacatttagcccaaccaccctatgaagtttggcagtacttcttgccattctttcaatagataatttatttgagtttaagggagagtctatgaattaacactagtaccaaaactcccatgagaaaataatgtagacagcttttgttaaaaaagcagaatttttaaaggtgttcattcagttatcttcttgcctaacaagttcctgtgttgtgatagactttgaatttgttaaatatgaattggcttcctgattctagctgttttgccagaggcctgatttagagaagggattaaaccactggtcaaccttggatggaatttgggccagcagttccttctccacagcccctgacacttggctttgtgccaagaaaatcctacaaaaggaaattgatttactctacccaagacagagttccggaggctttggttgtccattgttagcttagaagttggcgcagtgtgcgtgtgatccacgcctaaatagcacagccttgctgtgcgtggtagaagttgggttagtgttgacatgctgttgactcaccctcccgaggatggaagctctggcctgggtcaagttgtggtcactgcagttaacagtttgttgatctcagggagtattccacagttgctgatgtaattgacaatgattggagccagctcttccccagattcaaatggaccaattagaggacttgttggttctgtttatcaactatgtaagtgagtactgtgaagttggcattgtttttagtctgtatttgggtaagatgaaactctgttctcagacagtaatatctttcaaaagtacaatgttacttattgtgaccaaagtagggatgaagtttgcaaattatttggtgtaatgatttaatttggccatccatgcagtgcagttctctaccagtgtgattgttctctttgtaaaatactcttactttgccagaaaattgtttgtttgtttgtttgtttgtttgtttgtttgtttgttttgagacggagtctcgctctgttgccaggctggagtgcagtggcccgatattggctcactgcatccttcaagcaattctcctccctcagcctcctgagtagctgggactacaggtgtgtgccaccacgtccagctaatttctgtatttttaatagagacgaggtttcatcatgttggccaggatggtcttgatctcttgacctcgtgatctgcctgcctcggcctcctaaagtgctgggatacaggcgtgagccactgagccctgttgaaaattcttattaataagatgtttctcatagaatgtttcaaaaaattgtgactggtttcaaaatcagatgatttgcaagaattagccatagtataaacacatagttctcaaaccgttttctgggagtgggcccagagatctatttaacaaaaccttgagtagagtctggtgcaagttaaaattggagaaccactaatgtaaccttaccttatctgtggaccacattttgagctttggaagaaataaccctttctatccttcacaaggtaacagatgatttttttgcacaattatttgataatgagcttatatttgagattaaggtatgcacacgataatgtacattctcactctaggtctggggaccttgattctttgactcttctgtccttttctctccagttacttggttttgtgcattaacaaacttttcaatttacttatttttttttacttatttacttatttctcatcccttacgtaatgttgcatcattgttttttgtagcctctgcagttcaagatactaatcacccctttctaccacattaaaatacagactctacctaaaatcatgtatgggagtaacttgatatatacgaaagtgtaaccgtgtcacaattccccgccccaccccgccagtctacataaaactgcaaacactttattgcttaccaagaaagtagacaataatatcgaagaaagccctccttttcctcttctttgaccaacaagggagcagttcctgacaaatgtcagtttgctttttgagttccttaggtttctgtgttgtgtttgcaatggataaatattgagtaacaggtactgactgtattgtatacattgaaaactatccaccaacagaatatttgcaggaggattttgttttgttttgttttgttttgttttgttttgttttctgagacaggctatctctctgtcacccaggatggagtgccatggagtcatcatggcttactgtagccttaacctccttgtctcaagcgatcctcccgcctcagcctcctaagtagctaggactacaggagaggaacaccatgcctggctaatttttttttttttttttgtagagacagagtttcgctgtgttggccaggctagtgttgaactcctgggctcaagaaatctcccaaagtgctgggattataggcatcagccactgtgcctggcttgagaatgacattctataagtagtttcagtcccttagtttaatcccatattttgatcctataacatgtacaatatttgtgtatagtatatgatctgccaactctctaagaagattttaaaacttattatgttaaatttcagacatatacatcatccagcttcaaaaattgaccacattttgctgttcttgtttcagcacctccccctgccccattttcttttctgaagcattttaaaataattctcaggtatcatatcattttacttctgttcataggtttctgaaaggatttgatgcagaatgttattattaaaccagtatacagagagaaaggccactggatattagtacatgttttggtttcagacggtccttttaagagtatattaaatcacataaggattttctgagtacccattagaaccacaaaaaatacctatgatacccttcttactgcagtagaagatgagtttcctagggtagccctttgttgatggaacaaacatgtattttgtttcatcaggaaaatcattggaacagccatgactcagatccactaaatgaaggaacaaaaataggacctgcctcacctcctgatttttttttaaatctctaggatgagtaaccagaatatttttatgttgtgctaagtaggtttgtttgtttgttttttactctgacttatattatttgaattgtagaaatatattgtttttacttttttctttaaaattctatctggagtttctaaatgagagattgtagctcctaaaacctttcttagttttggtgtcttgctttctgttcttagcgtctgtggtcatttctaactcccagtgaggaaagagctctctggtcttgtttctttgttaaatgaaggagcaaacctccgtctcgttgatccactcccaacccacttgttttgtaacaatgaaagttatctcatacttaaaagacaacttgaaattataacacacctgtaacaaagtaaagggtatgggtttttacttaggtttaaaaaaagggcagtaacccttttcataaaaaagcaaaatttagatgggatagaacccccgtttatagaaaagattttaaaatctcatttgctctcattgaaaccttaaccttctctcaaatactggcgcacctctgaggaacttcaaatacggtttgaaaactaatggtttaaggagggccaggcgcagtggctcatgcctgtaaccccagcactttgggaggccgaggtgggcggatcacttgatgttagcctgggcaacatggccaaatgctgtctctactgaaaataggaaaaattagctgggtgtggtggcgcatgcctgtagtcccagctactcaggaggcggaggtggagaggcgggaggatctcttgaacccaggaggcataggtgcagtgagcagagatggatctcttgaacccaggaggcataggtgcagtgagcagagatcgcgccactgcactccagcctgggtgacattgagactgtctcaaaaaggaagacgaatggtctaaggaaactagtttgtggtttctcagcggagaatgacattctagtttctacagatctggcaacagaagacaggcacataaactggcctgctttggagtcagggccaagacttaaatccagatttaaaaccagctttttttttttcttcttctaaaacaaccaacctgtgttttaggtccagtgtctgccttgtaagttgctcaaagctcagatacaaggaagtaatcagcacacatttttgtgataacattcctgaaaagaaaaagatgaggtggactaaggtaaatacactgctccttaaaaatccatatttttagattatttataaatcaaatgggcatggttaccaaagatgaattctagaggtgtaaaactccagtcttatacctcaaatttcagttttccttagggagcaaaacacttccatgatcttactgaggacctaaaaaagcctgtacatattttaaaaatagcactccctagataaagcctgatggatccagggtacagtagaatcatgaaattgcctgtttctttttaaaagatgtatatgattgctcggtggctgtatattgtccatcgtgtgcgtgcctgtgtggtatgttggttctttcagagaggcagtggcgtgcagagtgagaggatcacagatgtgtatgtgacaaaactatttcttttctttcttttcttttctttctttctttctttctttctttctttcttttctttcttttcttttcttttcttttcttttttcttttttgagacagagtctcactctgttgcccaggctggagtgcaatggtgtgatcttggcttactgcaacctctgcctcctgggttcaagcgattctcctgcctcagcctcctgagtagctggattacaggtgtgcaccacgatgcctggctaatttttgtatttttagtagaggcagggtttcactgtgttgttcaggctggtctcgaacttctgacctcgtgatccgcctgcctcggccacccagcgtgctgggattacaggtgtgagccaccgtgcctggctgacaaaactatttctaaaacacaagtccagatattcctaccaagggctctctggggcttcgttttgatttatatgcaaaacactcctaatgtggtgacattggggagataaagatctgggatgatgagagagaaaggcaggtaggacacatgcccttccagtaactttccagctagggcttgcatttaacctctgatggaggcctcaccatccaggcagatgtacttgcttaggaatgagtttgagataataaggctaaatgtgctgccttctgtatataatttgcatttgtcctaatgtacgactaaggaaatgaaaaatcaaagtttgagtgactaaaataaaagaggtctgtggagtaattggattgaatttgcaccaagtcaaggagaaaacttctgtattttgtatgttttgtcatggttctatgattacttgttagaaagtgatataaaattcaataacttagtttgatatgaacttggctatctttaagttatagaagtcgtgcatataatgtggctgttttcaacccccataccctttctgagtggttggagatgtcttgaatttcgaagtgagaaggtctggtgctgttacatagataatcatgttagccagctttaccttctgataagctctcaatttaagaaagtacttctaatcctggctttatctttggcttgctatcttattatgcacagagcataattgtaagaagggaataatatctcttgctgtctattcactaagaatagtgtgaggacagggctcttaaaaacatgaagagatgggcactattgtatagatatagagatttgatgaaatgttaaaatgttggatgattttaaatgacaagtggagtggtgagaagtttatttttaaccttatgtggataccttggatatttagaaacatcgaagttttaaggaagaacaaatatcttgactccaagaaaatggtcatgtgatactgtggcatctatttggtcttcctgatgtatatgtttcctgacatttagctcctaaaatccttggaatctccagtgctaagaaggtcttatatgctaatgagatgactggtggctgggtaacctaccatgtgattagagggttaggactttcagtcaccctccccaacctccaggagctgaagtttgagttgataaactaatgatcaatgatacctacataatgaagctttcttaacaaccctgaaggaccgcgttctgggaacttccagatagctgaacacatggaggttcctggagggttggatgtcaggaaagggcatggaatctcgttttctcttcagccgcacctcaccccgtgcatctcttccatctggctgttcatctgtgtgtcctttgtaatatcctttaaaataaatgggtgaatgtaagcaagtatttctcttagttctctgaaggtgctccagcaatgaatcaaaacgaagtaaggggtctggggaatggtagccagttggtcagaagcacaggctacaacctggggcttgtgattgacatctgaagttgggggagttttgtggtactgagccctcagcctgtgggatgtgtaatctccaagtacagtgtcagaatccagttgaattagaggacactcagctggcatccattattggcatgcagtattccttgtcatgagcctgggcaacatagggagacctcatctctacaaatatagctgggagtggtggtgtgcacctgtggttccagctactcaggaggctgagtgggaagatcgcttgagtccaggaggcaaacattgcttctcctccaaatgctgtactttaacatgtttggaaactcctgcaaaggaatttcaacataagcgaagtcaatgggttataaaggactgaatgccattttgtaaatgtcagaaatcaaagtcacaaccaagttaagttctagattagggccaggaagagaaatgtattatctggtcaaccatatcaaatctgtattttggtggaagagcattttcttatattggttctgattggtttgatacggacagggaactgttttctttattccagttatttgttttgttttgtttctgagacagagtctcgctctgtcgcccaggctggagtgcagtggtgcgatctcggctcactgcaacctctgcccctcaggttcaagcgattctcctgcctcagcctcccgagtagctgggattacaagcgtgctgtagtttttgtatttttagtagagatgaggtttcaccatcttggccaggctggtcttcaactcctgacctcatgatcccacccgcctcggcctcccaaagtgctgggattacaggcatgagccaccgcgcccggcctattctagttgttaatcagttaacatagccaaaagatatagaataagattgtagactgaatccatagtctaatgatttgtcttcctagtaattgtgaataattcagacattcaaaattagtctggcatcatacaaacattagactagtcctaaaatgaggatattggcaagtgtgttaataaaaattgcatatgcagtattaataggttccttacgtaggctgccgattactcaggaactgtcagatgttttgttttgttttgtctttgagagatggggcagggttttactctgctggagtgcagtggcacaatcttggctgactgcagccttgacctgctgggctcaagcgatcctccctccacagcctcctaagtagctgggactacaggcatgcaccaccatgcccagctaatttttgtatctttttttagagacggggttttgccatgttgcccaggctggtctccaactcctgagctcagggatctacccacccatgcctccctaagtgctgtgattacaggcatgagccactgtgcccagcccccagatttttaatcttctctttgacattgagtttcagaaatgaagtataaatggtgaatttttagtgtagaatatgatgcactaggaagatcacttacccgtttattcactttcttagaccatgtcaacccgattctgaatttagggttctgttgtgatggtgttctttagaagtgattttaacactcaaaatactatagtctgtaacataatttactgattttttaatttttgcaaactaagttgaagtaatcaagtatttatgagttctttgggtgagaccatctgtcaaagaattctgggcttaatggagatacatatatgttgtgaatactaaacagatatccaagtaataaagcagaaatcatatgctgtgtaacagaaatgtaaagttctgaattagttcacgagtaggagagaaacttttttttaaaggtagaggagaactaaaagtaatttcttaaaagagtgcctattttacatcttgaatattaaaagtctaattcagtgccttgggatcttgttctttttgtagattttgatttgaatgaacttcagtttgctgaaatgtctaatgggtgcaaagtacagatttaattataaggttgagctaaaatcagaatttaagcatatggcatatataataccaatttaatctttcccccttaaatttagttatttttagtgagtcccaaacaccatatttgagacatcacttttttcttttttaaagagatagggtctccctatgtgaggctggagtgcagtagctattcacaggctcgatcatagcaaactacagccttgaactcctggccccagtgagtgtaatgtctcaccatgccaaagtacttttatcttaaattgcttatttttttgtttatttttttaactgactctgtttacaaaattaaccttttatctagtgacagctagattgtatcacatttgtcatctatggacaactgatttttagttgtttaatatggtaagtttattattgtttttccttatttaagaaaacaggatctgagtgaaaaaaaaaaaaatcttaattcaactatcacgattccagtaggaagtagacagacattcatctgtatacattaggtgtcaaagtagagttttgtggtttatcattctgaagatttgagattcaagacatgactatctttcagtcatattgtgcaatagataacatataatgtttctcactgatgagaacagttggttagatctctcagatgacttgaattaggtattagttcaagtcagttgtcagtaagtttggctttatcgttcagaggagcttcttatgactggacatttctcaagtattgccgtattggtcatttggctatcaatgcttaaattatactcagtatagtataaattttcttatttcccttatttaagcatgcctccattacactgttgttgtctctaataagagtttaataatctttgttttggcttagtaaaaagagccaacaaatatatgagtgactgactgagtgtattgctctatgcgcaattgtcttaaaggaaaaacgtttatagaatcactgtgaacaataaaatggttgcatttcgctggaaaacctcggtgctcctttggtaaataatgaagtgttttgttttacgggccttttcactacttcattgacaacagacctttttttttaaattaattaattaattcatttatttatttatttattttttgaggtggcgtttcgctcttgttacctgggccggagtgcagtggtgcgatcttggctcaccgcaacctccgcctcctgggttcaagcgattctcctgcctcagcctcctgagtagctgggattacaggtgagtgccaccacgcccagctaattttatatttttagtagagaaggggtttctccatgttggtcaggctggtctcgaactcccgacctcacgtgatccacctgcctcggcctcccaaagtgctgggattacaggcgggagccactgcatctgaccaacaacatatatttatattacccagtaataggcatagtctaaggaagataatagaatttattcttagtagtgaactctttggcttttgaagcagaatttttttttctttgttcttttctgtgatagtaaggaaggaaggaagggaaggctactactaaaaatataaattgctaaatagaagtcaagtctctgggtgttgaagctcacatattggtgctgtccagacctgacgcatctagaaacaggaatttgcccttagcgtaagcttagccaaatggttgagtcatttctaagtattttaacattatagaatgccttaggaaatgtcatgaatatctaaaacaggtcttcttgaggattttattagtttcttaaaacatggaaaggaacttgattctcagtgctggtacctaaaattcaaagacattagttgtgagttgctgtgctcctcagctctaagccacagttgtcatggccaagcctgtctccttatggagagtggccttgctgtttcctgcagagcttctcttgtgcctggcttgtgcctggaagtcagcgtgtcaccacttcagagagacactatagaagcttggtgatcttcaaacaagaacttaaaacaaagaagttttctttcacagatatcttaaaacttgtagctaaataaaacgtgaataactgtgagagcctcattacagcaatttttaaaaaagcagtacatgttttgttgtatcttaaacatcacagaatggtattgtgtgtccagttttgtttgtaaaatgtaaccttcgtgtgaatgaccatctattcctttctttttggaaggttagtttgtcagctgttgtgtgatgctcaacattttatgtaatgacatttagcacaacgtttcaatataacatctcaggaaaacatttaagaaatagtgaagttctctgggtattacattaatcatattaattacctgttgcttttaatttatcaccgtatcaccctaatatcacaaggcatgtgtagtactattttgtaaagattttctaaagaccttccctctataggaaggaaaatttaattcagaaattgggctgaactctctttcacttgtgtgaaaatgggaaaattagaagtaatttgtattttttattgtgaaatcagtgtaggaacctgtgctcgtatcatggaaacaacagcactaatgtttttctcccctcgggtgtgggctttgctgcagatatccatgtcttctactttttctgttcttagttcttattcacttattgtctatacttcgtgtcactttattgaatttcacaaatgcaatttaggaatccagggatgtgataaaatttgtgcatctgcttgtcattagccatctcacgtttatatcgctaagtgaaaatttaacttagtttggaacaaaccaccatgatttagttcacctgtatagtttaaaagacctaagacctgaaatttttttttttttttgaaacggagtctcactctgtcacccaggctggaatacatggtgtgatctcagctcactgcaacctctgcctcccgggttcaagcaattctctgcttcagcctcctgagtagctgggattacaggcagctgccaccacgcatggctaatttttgtatttttagtagagacggggtttcaccatcttggccaggctggtcttgaactcctaacctcatgatccacctgcctcggcttcccaaagtgctgggattacaggcgtgagccatggtgcctgtccaagacctggaattttacactgcattgggaccttataaaattcttgacttgtacccttttggcattttctgaatgctcatgatttgcttctgaaatattttaggcctttggaaacactccttcattctaatcctctcttttcttgctctcaattcttcatgtcatgtaattattttgcctagagccaaatctgatgtgttattataatcatcatttctgcaggagcttggtaacactcctgcttttgttccctttaaggcttcttttggttttgtttattttgtttcactcagaatgatctggttaagttttgcttgatcatccatttcaaatctcttagtacatttttcaaattcagttccaagcatgttaaatgtgtcacaatggaagtgtcccacggtcaaatacattttgggaaaccttggttttaaaaaagttaaactgacttcattattacggttttttttttcaaaagcctccagtatccatcttgaatgatccatttcccatatgtgttttatgacagaattctccccactcccaggtaataactgttgacattttctgaaaactgtttttgagaacactgaattagatatgaaatgaggcatttattcatacttcgaaacgaatgtcttaaacctcactgggccattttgagtatacattactagtgatatatttaataacttagtggtataagcatgcaataacaaatttcttacacaagagaagttctgtgtagaaacaaatttaatactgtggctaaagaaatgaaccaaaaaaatttaatatcttgaaatttgcttcttagctctgtttagaatcattgtgattcacggatagtaaattgtcagagtggacttcatgaaccttatatcagacattctgaaaagagctaaaattgccattaaactgcatgagttaaaatatcttagatagtttaaaaatactatgtagacttggtgagtcagatctgccacactgagcgtgtagctggggttgacgacacacgtgttgcagtgtcgttaccagtttgtctcttttagagacaacttggcaggcagacgtcttgcagataaacaaggaaagattgtctattttaaatggcataagacattctttaaaccagtgtgtcatatgtggttatatagtcagcattttctttagtgcaggaaatcctctctcagggttcctgaataaatagcaggtatctttgtagggatagctcgcaggagatttcaaatgctgtgtattcatcagttcaggctccccagatgtcttacgaacgtgctcattttagttttcttttcttttccctcttcctgctagatacaagttgagacaatatgattagctcttaaagtgcttactctccattttatgtatattactgcattttaatcctcataatatcctgtgaggtgggatgttactatgtccatttgagagataaaggaaatcaagaggtaaagttaactggctttctccaaacagctggtaattactaaatacagaattgacttttgccttttgattccaaagatcatattggtactttcatgtgtgggtcccttcagccagttcctacagtgaccctgacccagctgtaagtcccctgaggtctctagagatatagacagtgatggattagaccctgttcatagttgcagatacaagacatagagaggtttctagcaataatttttttagttatatattttcatagggcttttgatttatgtaacctattagtatatatttgttattccagtagagttaatacattattcaaagagattccagtttttaagccttttctccgtttgtctaagttgttcattatgaaatgattggctagaatttgaaagtctttacctacagagagattctgactggcttgcttggtcttggaaccctagttatgagtgcattgtcttgcttcctggtgaactttgcccagaaatagttaccacctcattttttttttttaaatgaaagctggataattaaccctcaagatttcttaattaaaagattactattataaattgacccacagggagttaatacaataaaattatttttgatcattttatatgaaataattatggggcaatcttctgtaatcttgagttgaaggggttatcttgcttaatgttaataacttttgatacaccaactaccttttaaaaattaacgttttttttttttgcttctgtggaagggaggctgtattttgtaggatttacagtttacatagttattgttttatatgatgtcagttggattaattatgttttgagtggaaactctgtttggttcaaccaatatttgaatgctaattttgttctgtgaacaaatagaaatacagagaacagtaagacatgactctttccccctaagtaaaggcttaggttggagttttcaacctgggaattactgacattttgagccaaataattgtttatgttgggtgggggagggcctacagcggaggctgcctgtacattgtaggatgtttagtaacatccctagcttctacctactagatagatgccagtagcaccacccaagtcgtgacaatcatctttgccaagaactttgaacctctacctagaaacagttcatagggctcaaaaagcaaagtggcctaggacccatgtagttaacaagcttaccctgttggagaaccactgcatagctgaacaacatgggtgagactagtgtcagggtaaaggagctcttgactggagattggccgtacacagaaaacaaagtgagtgttatggatatttggggatttaccttcattagggcacagttggttagcgttaggtgtacaccaacattattccctctttagaaacagccatgcacgtaacattttagcacatctgaagaggcacttctattctaattacctaaaattcttattatctagaattacatgctatgaacaacagcagtaaagtcagaagccagaatctatgtgatgttatctgttttgcgatcacagttgtgttcttctcttagtttatttgaacaagtttgtgaaaaaatttttgtgcttatgtaaatactctttgcttagattttttggtagaatgtaaatctttcccacacagtgcaatacccctcctgcccaagggcgagatatagattgtacagtttgttatttctgtgttttagggcttattcctctgtagacatgtcaaaaagacatccgtcgggggtaaggaatgcattagcaattcaagctgataatctgcatggtgagagtccagataattttttccccaggtcacataggcagctctgcacaagtctgttaaacatatgctagttttgaaaattaaaataagttcccatcactcaaggcaatgaaacgtagatgaattgctctgccagattgactcttagaactcctgatgtgatgtggggctagacagaatgggatgtttgctaataaatcagggaggtagtgattgttttccttctttttctcccccacccccgtcaggacaaactcacattctgtagcctggtgcactctaataatgcctgttgaccttggccatgaaagcactctagactcaccccctaaacaccgcaccgaatgtgctcatccttgaaatttacaagccttagaatcttccctacctccactcctgtttactgcctcctgttactcctggtgcttccagtcagaccgtagtcttggctgtgcagtacctttaggagccctcaaaaatgtttaatttcttttaaaatcagaaggaaaaataaagaacaagataataatcatgaatatacaataatgaatccagcctgacttagagttgtctttataccaatcaacagagccctaaaatatagcttttaatgtttttttaagagagaaagaggcccacgaaagttgtcctggggcccccgcatcctcctcatacactggtgggatgctgctcttgcttgctttggaatgtggcagcagctcccagtgacttcacacgtttattacaaattcaaggtcatttggacgctagccttgtgctacctttcatgcttcctgtccgacccatactcagcctgggcatgttttctgctctgatctttggtctgccttccttctccttctccaagtcaaaccagtcactctttcctgagagctcttcggtgtacccttgccagacctctgcattaacactccagcacctttggttagccaatttggccttatttgtgtctccaccattggattatctgtccatcaaggtcaggaatgttttcgggttaccccactgtccccaactttgaatatgttcactgcctggaaaatgtttatctgaatataaggcatcaagccagaacttgcccaaaacttaacctaggactcaaacagctttgaaatcttatctgtgtagagtgggaacggcatgtgtttgataaccatcagcatttgctgttttgcttagccatcaacaatccgtttctatctcttcctcatagtattttcagctgtatttttgtacagcagtcattcacgttaggtgttaggttacactgaaatctctgacaaccagttctgtgctactgaaggcttttagcagcaggattaaaaaaatagttgattgcacattcgaagtctcactgctcacactgtttatgtaattcttggagtccagttagatcatctgatttttaaaatgttgcctgaattacaaaggagttcaggaatgtgttatcaaagaattaggaaattaacattgaaatttattgagcaacatagctaataggttgtcttgctttttaagccttcttgttttctaggaggagcctgaagtccgtggacaagttgaactgtagctggtatttaggaattggtaaagacagaggtgtggatgctatgttttcttttctctgttaggaaattactctcctggtgccacaataaaaaatttcacaggtatctaaagtggaatttattttgtattgttccacacctttgtcaataattacattttctaccttctagtttattactgttattatttttcatgccaggtgtttcttaattgttggcataagtatttattgaatgcttatatgtgggagtgagagagtcaggccagtgctaaagagtagggaataacccctagacagtgaagtaacttttgtcttgtttgcacattaaaaaaaaaaaaagattaggaatccttgctctatatactagaaatgtttgatgttctcttttcttctcttcaaacagagaaaacttagatgaatacttataggctctactgtcaactaactgcaccctcctaatattggcgtctgcatatttttaccattgtcaatatcagattgcctctgatgttgtgtcactgaaactgatagtaacattacatccaagagtaagactgcagtgtgatttttggctcttggtcttctgttctttcggcaacaattttttataaatatagtcaagaaaatagaaataagagtcttcactgctacctccccttcagaattattttctcctagtattgtggttcctgatagcctttattcctatagaaatggcaattcgaaaaattccttctgtgaatctgagggctctacaaagggagagcttctttgatagtgctttggtgtaagttatttaagaaggacaatctacccaggcttatcaagcaaataacctggaatttaaacctggagtattctttagtgttccaagtctgcaggaaaagaagtaatcttggcttaaactaaataagttaacagaatacaatttgaacaatgaacaagaatgctgtttgaaaattatcttgggtttttatgtcaagttaatattctcactgaatttctattatgtttgtaaagcagctttctcctagaccaaaaatcctagtaataaaaccacaacagtatgagagttataagcacacagtaaaggctgatgagtaaatgttatgacactttgaaaggaaataaaccagacgatataatgtaaatatcctttgtgcttatcaaaaataagtgacttcatgttctgttcctgcaatatttctgtaaatctgctaaaaatagaaaggtaaaggtctaagatcataaatctctgatgccctttccttaaaagtaaggaattcttgtcttggattcttatataatatacttatttataatctcacttgttctgattgcaggtggcctcttactatctttacatccatgtgaatgtgtgtgctttgatgtgtacatatgagagacaagaacaaaagtaaatgtcaaatatccgaattcctgtttcagtgagctttcacggagtaaattctttttgtctacttgcctgtgatctcttctaatatgacttgcgttaatgacctttaagaaatcttttaataaaataaaaaattttattaaaatcttttaataaaaaaattttattaaaatcttctaataaaaaattttattaaaatcttcttcatacgtgttacttgaatttactcatggcaaggaccagttagtaccattttatgaaatcacaagctcatgggcttgtgataaaacatataagtgctttaaatttggcattggtaacggcaggccgactcacttgaaaaatgctctgaactgctctgcctcatgctggtgggaagtcagatggaaatgactttctagagagtttagctggcctccaagcttagtgggtactcactctccttatcccccgatagctgctctgagattttaatgcacattgaagacaatatgataacttaacctggaaaattagcattttggtaagggtctttaacttcattagtattttcataccactttggtattagaaattgtaaagatattaaagggtatggacaatgtggaatgtatgtaccagactcagcagtgtatactgactccctcactatagcccagaactggaaatcccgctaactacctctccccatcctagcctgaattgccctctccacctatgttggttttacaatggcctgacgcctgaaagctggtagaaactgtataggaaaatagggttgggataaatttctgggctgacaaaggatagaggaatatgcttctttttccccttgtccaagtatatcagcaactctaagatgcagatttatcagtatggctctactgggcatgttctagttaaatggtagacccactacctcttctggaatcttgttttccattatattcccacctgcagcttttcaaagacttattctcttctctaatggtctcttggttcttttttttgcccatgctctacgttccgagtgggtcaacattgcagtgggtcaatgagaagaaatagaggggaaaaataaaagaaccagaaagaaacctgttaagtttgcacttacttgtgcattaagcatattagcgtaagccttaaactctagaaaactcactgtagtgctgtaaagtaccactgataaagtaaaagttcatttttatgctgtgtcgttatttagtgatgaatatgatattgcataaaagatgaggatctgtaaggccaggcgcggtggctcacgaggtcaggagttcgagatcagcctgaccaacatgatgaaaccccatctctactaaaaatacaaaaattagccgggtgtggtgacgcgcgcctgtaatcccagctactcaggaggctgaggcaggagaatcgcttgaaccagggaagtggaggttgcagtgagctgagatcacgctactgcactccagcctgggcgacagagtgagactccgtctccaaaaaaaaaagatgaggatctgtgtataactgccaggtgttgtgtgaggtaccatgaataacctggcaatatcctaactgtgcaggtatgaggagtgacccccaggaatataattgcaattaaacttgcaaattatgtggggatactctatttcagggcaataaaataaattatgtctagagctcataactcttacacatatttggctaggtctatgcagcaaaacccaggtgataactgaggctttaactttgggatttgtttggtgctgactctgccacatggtgaaatttggtaggatctcagtgcgagtgtcacatgatcagtctgcttgacccaacatgccagaattccatttctcagcccactctcttctctgcatacatacctacctcccggagagggctgggcgggagcctacgtgtggcaagagccctcactgcttttgttacacagatttcaacacatatggcttgatggagtgtgattgcagtagcatgaatgtttggtgatgaaatttgcatgtcctttgctgggagaagtataattataagatttttgtattcacatagccacatgtgaggtatgagcaggaacggggtctatttaatagcattagattgctttcagatttgaaatatttccttttagaaatatattgtgtaaacaaaatatgtttaattttttttaaaaactatgcctttgtacaaattgtttatcatttgcagaggtctaaaaaatgtaggagaaaagaagctcacaaaatcaatcagatctaaagattgcaaagattgattaccatctccttaaaagcttcagtacatgtgtttacagtatcattctatttgcctctgctcagattctttccaattctaggacaacccaaagtgtatagatcataagccataactgatcctaccttacataatacattaaatataaaatatttatggccaggcatggtgaccagttctgtaatcccagcactttaggagaccaaggcaggaggaacacttgaggccaggaagttgagaccagcctcggcaacatactgagaccttgtctctacagaaaaattagccaggtatggtggtatgggcctgtactcccagctgcctaaaaaaaggcaacttgagaaagtttctaccttctgaaacaatctatgccttgattctatcacttagtattttagttattcctatcaaatacatgactgtgttaatttcttttgccacaaaaatgctgcaaagccacaaactcactccaaaatttagtggcttagaacaataaccatttattatagcccacaagctcaagggtcagctgatcccggcttagcttggctacatttgatataaaacagtagaaatttagaaattgaatatatgtagaatatctcttgtaccaaaaatgaagaggaataatagattttgatttttctttgttgtattctgtgctgggtgctaatctgtcctagctgtcagaacaagtagaagccatactggaaaatcatttatttgttactatcaaatttatttcagtgaatgccattcaaaccactctctctgaggagcccagttaccaagtcctccaccttgttagcaacatggacttaaatgcactaattctagaatgagatcttagcaaagtaccagcatttgagatttgtgcaaattgagctcttaaactgtgtgtatatgtgtgtgtgtgtgtgtgtgttcattctagcactcccactacataccatacaagtagctgtatagcaggtatatatacatgtgtatatgtacataggtaggtatatgtcaactgttgaaaaactagaaaatacacattaaataaagtaagggttgataaacattagtagttggaacattgggagatttggacttctactttgcagattcagttggctgcattagatttaaggaaagaactaactttggagaaatttgtgtttgcatttcaggagagatttcttaaagaggaaactaccagaggttagtagatattaacatctagtgatttaaatttgagaaatgcaaattagacatttaagctgtgggtttgcttcccgttttacttgctctaaaagtaatttttttaaaagccagtaacaaagacatgcaaaatagtactgccatgggggaaaaattacttgaaaataatattcaagattgaagaattaaaaaagcttgacatctagtaccaggaatgccagctggcttgttctgtcaaaaagcaagcatgtgctttggaataacactcttgagtagactctaggcgggttttgagcccttctgattatctaaatagatgtggaagtgacttatcttggtttttctgagtcaaatgagataatgagcaaaggccttagtaggtctttgatttttgcctctaaccctttttctatctgcatgttcacaaggtcaaggctgatgagatatggcaatattgagagagtcagaataggataaagatctcaaatactatatatatatttttttttcatttttttttccctttggtgactgtatgagacatgtcagtaaaactttaaagacaggccaggcgttgtggctcatgcgtataatcccagcactttgggaggccgaggcgggcagatcacttgaggtcaggagtggcaacatggcaaaaacccgtctctactaaaaaatacaaaaattagccaggcgtagtggtgcacgcctgtagtcccagctactcaggaggttaaagcacaagaatcgcttgaacccaggaggcagaggttgcggtgagccgagatcaccccgctgcactccagcctgggcgactgagcaagactctgtctcagaaaacgaaacaaaacaaaagacacacagaaaaactgtaaagacagaatgaaagagatgaactttttacatctcgctcatttcatcacatactatatagtatgtgtatggtttcatatatgttagtgtgtgtgtatgtatatatatgaagttaaaagaaaacattcaccttttaagactaaatggacattgactagattgtaaactgtttttgaggctaagagtttgtttgccatgcataaggctctattttttgtaattccacttttatattcatttatatcagtcctagcagtagatgccactcttactgggtcctgcctaaatgcatgcttcaaatgttggttattaatttcacgagtagtgaataacaaagactcctattgagggacctcttgatttcctactgggcaccagcagcaagcatgacttactggccttcttatgagtgggtaggagttttgggtcaacttgagaacatctatcctttgagtagtaaaaaagcttggtattaggttggcacaaaagtaattgcgatttttgcaccaatctaatatcaacagaggccgtgaaaaacatcaagggaggatagcttgtaattagaagccagatcaacagtgacccaaaaagaatttcaggtttccaggagtgaaatatgtagattactcctctgaaaggaattgtttttctcctattcgctttcatggcaaatcattttttaagccgaaactcaagctctgaaataattgtgtagcaaatagtggctgtgaatagatgtggcaactctccacaagggtaaatagaaaccacttgcagtttcagtcatcacattttatttttcttttttaatagcttctctatttttgctcaccacaaatacatgcacacacacacacaggggcaaagccttggaaaattgcaattttccattttaatttgagagacagcccggtcacattaacagaacccttgacggaataggttgaattcccttctctgtccctataaccccatggccttggacatatccttacctggtgccctttcctccctcttatggtccacttttgtgattctgattttaatttcagttctctgttagtgatgaaatgagcaactgcagatgttccgcttacactggaaatacttttttggcatttaaaagaaaaccctacagatgaattattcccctgaaaggggttcactcagattttctagattatgattctagaaaatagttctttacatttgacaatggagaatttaaatgttttaatatgaaaatgtaaagcactcttgtggggtatagttgaattatgcccaggttaagggaatccagtatttatgtcaggaaaccatggatgtgatagaaatagtatcgctacaaagctgggcacagtggctcatgcctgtaatcccaacattttgggaggccgaggcaggaggatcacttgaggccaggagttcgagaccagcctggccaacatggtgaaaccctgtctctactaaaaatacaaaaattatctgggcgtggtggcacaggcctgtagtcccagctacttgggaggctgaggcaggagaatagcttgaacctaggaggcggagaggttgcagtgagccgagatcatgccactgcactctagtctgggtggtggagtgtgacagtgtatccaaaaaaaaatactgagattatgcaagaatctgactcgaagaagtttgaactgattaaaaagtaccaaatacttcattatatgaggccagctatttagactagtcagcgggtggttcaaatgcagaaaacagatggctttcattagccagaaaccttaaaattacataaatccacggatgcaactaagctatggatctgtgccctctccttgccaaacaggacctctcagctagcaaaacagagagctccttgttcacttttccctcctagttgagaccctgttggggaggaatgctgccaagcctgctctataaggaattttgatctcctagatgataacagagagaaactttttggagaaagggaacaccctgtttgaaaggacaacaagagaacttgttcaagaaggtggctttgcatttaattgaaaattgtagcaactgtaggcgtagggtttccagattcacatctgcagactggtccagattaggtatatatgtttatattcgtttatgttatccccttaagcctcttttaaagccatttctaaaaattgctttggaaagtccatttcacttcagtattctttatattgtggctcaaaaatattttttttctggtaacaaaaatattttctttctgtttttaagacttgtagcatttttaagtttgatatgtacgtctctgtagttcagagcacttggtaaacagcctcttgcttttgaggcaatttatgaatgcttcattgtttttagctggttattttgttcattgtcaggaacactgttttcccatgggaaagcatctccagttttatgatgtcagtggcaagtcattcagtttacaagaattaccttcatattcagtcttagaaaagcatagaccacaaacggccagttatatcacagttctcatcttttaaatgttgtcttagatttttgcaaagtaatcttaactcaccttagaatagtgttaagacataaatagaactaaaatgtagtagttaagtggttatatttcccatctactaaggtatttatatttcttttcttttagaaaataaaaatgtttaaaaaattaggaataattatctttaggatgactttgtaagactgtgcttttttactggcagcaaatacctgccagatttcaggtatttggcaggtaaattgaatcttaaaagatttcaattttaagagtgtccatattaacagatcctgaataggaccctgtgtatcatttattaagtcatttcttggaggcttcactcaggaaaagggagttaacccttggatggcaatgtttaatgtggccacatttccttctggctgaatgccagggagtggctgcgcttagcaaccaggctttgtttcataaatgggttatttgatgcaggtgaggatgccgtgagttgtttgtcttgttttaattcagggagacaggcatatgtagtgaaagcatggaattgtttgcagatgggcttcagtaagaataggaaggtttctggttcaatttgtatctccaagctaattgctctgatttccatatacacatctggtgttggttcggggggaaaaaattttacttgagaaacatggcttttgtgagttgatatttatttgtgaagggcctcttgtaatgtcaaatgtaagaagatctatacacacaaccaattttacaatttctaattcaacagcttaccctattattgaggattcgcagtttaaattattaaatgatctccacttgaagaaaatagagcatgttaatcatcacgattctccaaacatttatttttaaagttaatattaaatctcatctggtggaaaacctgacaggaactgaagcatatattttctagtctaaactctcattgttaaaatgaagacaacatgagacagttatagcgccgtaatcaagttatttgaaaaaaatgttttaaaaattaccactttttggtagtcaacatacacacatatgccaacagatggcattaaaaaatggcaagaacatgagacaattatagggtcataataaatttatttgaaaaaaatgtttaaaaaattaccactttttgatagtcagcatacacacatatgccaacagatgacattaaaatagctgtaaagtcaagaagcagggaggatgacaaagtgaaaaatagaagaaatcaaaggaagttaagtcaaaagaggaaaaaaaaatgaagcatttacttggtttgtcaggtagggtgatccagtgtattttgccaaaaactttcctggttttagcaccaaatgtctcagaacatggcagctgatgacctccctcacagtgagtgatcccagagagcaatgaagaattgtgatgcccttcatgaccttgttttggatgttacacatcatcatgcccttcagtgacctttctggtagcaaagggtttgtttttaaaagagttgcagcatctttaagtctaatatatacatgctcggaagttacaccatcatcacttctgctgtactccatttgttgcacagacagaccctgatacattgtggagtttcccagggtccatgaatagcaggaggcagggactattgggggccttcttggaggctggctaccctggggagagaaattgtcaatttcctctccttgcggggaggaaatggaatcaagtgcatttgtattgacaagaaggtagaacgctttccttagacattgtaatgaacagattgtggataaacaaaagtacagagagagtttgaggcagaggaggagactgtttcaacagaatatttaccagctatggtaaaggctcattagtgtctccgtacagttaacaacatgctgccaagactggaaatctttgggacaggaatgaattcggaaggtgaacagaataaagtactgtgggaacaatggcgattccattagtggattgtacattccttacgggcagggccctccatagcatctgatgtagggccttatccacaggtatctgattattatttgactttctttaatgtttttgcagtgttattatctatactacttatttcagtaagattgacaacatttgcatttcgatttctaagatcaagacaatgaatttcctcttaatccctcaggaaagctgtgaaatttaaatttatagagcattctacttagcctgctgctttgcatctgtcagagaatgagaccccccagtttcatggaagtcacaggaagtggcaaggggctcagatggagttgaggggttctagctatttctgcagatgatctggatattttggcatcggctgctttgacttaaccatctggcaatgtaaaggcagaatttcgttaaatattggaaaagttacttgaaaacatggctctagagattttgccagcagcttttgcactcatgacttggttcaatctaagacctgttttgtttttttgttgtaaggacctaagtcctctgttgggttttgacgaagtatgtgtaaaaatgactaaaatggccagaggtatcttattttacatttatgtgggaagaaatgtttggaaactgtttcatttctttaactgaaaatttctcagtgcaattttagttggtgtttttcctcctgtggacagtttttaggaatgatacaagttatcgtggaatcacccagttcttgagtgtgtgaacgaatggcttctgctggaagttaattcttcttggcatgggtgtctcacatttccccagcagctggatttgacaagggagggcctatcatgattaatatgccttctaattgattggtttaataacacctttactcctgtggatatatttttcatttcttgctgaatttttttttctttttgagataccagaacctgttaagtgacacggtatagatatttcaggacttccattttctcttttaaaaatatttttgtaaaggtaatgcctgtacacagaagagtttgaaaatacagaaggcaccctttttcatgaagttattttgtgaagtggtctattgcctgcaatggtaatagctaggaccccttacttactacccagcaggcactatgtagagctccaaatgagaaaatgttggctccttgcagatggttgggagaggagacaccagcactcttaacagacttgttaagagttgagactgataaccagagaatattctgggggaaaccaggagggatcgccaacatactcagttatatttgtggatggtgaattctacagtgaatttttctgttcaaaatcataatacagtcacttgctaactaccaacgccatacttgctctcagtgctgagaggtggcacaaatattattttcagtcttggtcatcaggcagggcctggcaggcatcatgctctgtgtgagtcagtggagtttattataagaatgcggtagcctccacagtgattatatttattataggaaaacgtgtaattttgttgtcagaacctttcagcaggtaccacaaaatctcatatgggaaaacgtgtaaatttttcatgaataaattcctttcggtattggtaatttccttctctgttttagtataaaagaaagcattgccttataggtggctaagaacatctgtagcatacataacacttaatctaaaggagtgttgaagaccgggctgattcctaattgagaatgagcaagaatagaactctttttgatagttatccctgttcttcctccaagcctctgccttggagctatggatactataactaactgaagcttcttctttcaggtacccactgatggtaatgctggcctgctggctgaaccccagattgccatgttctgtggcagactgaacatgcacatgaatgtccagaatgggaagtgggattcagatccatcagggaccaaaacctgcattgataccaaggaaggcatcctgcagtattgccaagaagtaagtcctgtccggtggctagcaattcacgttggatcacatgcatttgttttcaaaaaatttaacttcttgtattttgcatcagtattttaaccctacagtaaaaatcttggttcctaatgattcaccataccattaatatatttatttgcattaccctatgatatacatataaatgtttttaaaattatgatgtcgtattatgaccatcactaaacagtagtttaagatgtcacagcacttttttttttcctcactctgtcacccaggttggagtgcagtggcaagattatggcttactgtagccttgacctactgggctcaagcaatcctcccacctcagcctcccaagtagctggactataggcacatgccaccaggcctgactgattttttttaatttttagtagagatggggtctccttgtgttggccaggctgtctgaaactcctgggctcaagcgatcctctggctggacctcccaaagtgctgagattacgggtatgagccaccatgctcagccctccacactcctttcatcttcagtatatatctcaccacggctctacagtcaaggtcttttggttaaaagtgctagcattaatttttttctgttaccagcttgatacatattttagttcatttgtatctgtttgtattctattatagtttggttttttcctcccttattaattttactttttgactatcatgttagttctatgaaatatactcagaaagctcacttttcactcattctctattgataaacattttcattgttcctgatttatttttttggcaaaagaaaatacatatttttccttcttgtacaaaaaaagtacaaagttcactgttctgcactttgcttttttttttttttttttttttaacttaactttgtatcctggaaatcatcctttgtcatttcgtggagatcttcatttttgtttaattctttgtagtctttttgctgttactatacagggtgctcctttcttattcaatttaaaatagctggagttccaggcattttatctcacacttcttagatagttatctctgcattgtgactgcatcttaagaacattagaagtaattagtcttatgcttgttggcaaagcagaattctcgacactcattataaacagcagatagcctggcaacattttcttttgttgtaatcctttttgtactagaaatttttctttagcctacttggataatgaatgtttgttgtttaattaatattactattctattgagatccttttattttaaattgtaaatactaaaattattattattaaaaggtttaatttgttttgatagcgctctgtttaagaaaggacaagctctaattactaattggtgttttgagaagcaaaaagcatctacattatcacaatatattacatattaagtaatttttatcttgaaaggagtatgaaccatgatgtgaaatgatgaatagtggaaatcactaatacttaagttcattatatgtattttttgttttgttttgtttttttttgagatgacatcttgctctgtcgcccaggatggagtgcagtggtgcaatctcagcttactgcaacctccacctcccgggtataaatgattctcctgcctcagcctcctgagtagatgggactataggcacccgccaccacgcccagctaaatttttttgtatttttagtagagacagggtttcaccatattggccaggctggtcttgaactactgacattgtgatccacccatgtcagcctcccaaagtgctgggattatagccgtgagctaccacgtatggtccattatatgtatttttacaagaacattctgtgtgctgatttactaagtatggattgataataaatcagcttttgcctgggtgtgacttttataaagtgtcaatgttagaaataatatttacattctgctgaagagttcttgtagtacaattgtgtagataagttataaattttataaatcagaactctgtgcatacttatatgtttttgataccatttttttgatatatgcatacagactatgtattctgagtgtcaaataaactttttttaaaggctagaattaaaatttagtttatgacattgaccaaattgtccttttctggtgaatcgactattttgatacatgtgtcatagtttgcatctaagtttttcttcccttagtttcacgtatgaataaccagatgttttcacatttgtatggtggccataccaaaaattactcttcttgaccccaggaacacccctcttttcccgtttcacttagagatcctactaatgcctgggtagctttactttctgtcttagcctgttgtttgtcccagggtgtattagtctgttctcacattgctgtaataaactacctgagactgggtaatttataaagaaaagaggtttaagtggttcacggttccaaaggctgtatgggaagcatggctggggaggcctcaggaaacttagaatcatggcaggaggtgaaggggaagaagacacatgttcacatggccagagcaagaaagagaaagagtgtgaagggagaggtgctacacactttcaaacacccggatctcatgagaacactgtcacgggacagcactcgagggatggtgcttaaacattgaaaccacccccatgatccaatcccttcccaccagaccccacttccaacactgggaattacaattcgacatgagatttgggtagggacacagagccaaactgtatcaaagggttgagcacagagtggttcttcccagttctggactttaccagattgttggtggccaccatgagtggggagaattagccctttgctgtcaccttcctcttgcaattctggtattatctgtcctctgcctaccacccacccacggaagtcttgttggatgatacacaccagccagattcttcaacattaggcgccataagtaagaaagggccaaaacatcataccttgtgagccattttaatggatttgggctttattttgtagcaacaggaagtcactagactttattttttatctatttatttttttctttttttttcttttgtttttgagacagagtcttgctcttgtggcccaggctgcagtgcagtggcacaatctcagctcactgcaacctctgcctcctgggttcaaatgattctcctgcctcagcctcccgagtagctgggattataggcgcctgccaccacgccgggattttttttatttttagtagagacagggtttcaccatgttggccaggctggtctcgaactcctgaccttgcgatccaccctcttcggcctcccagagtgctgggattacaggcgtgagccacccgcacccggcctagactttattttttcagagaagaggagtgattgtagatttgcatttaaacaaatcaccttcttgctttatcactatgtcccctaccatatatcttcgttctcccagagactgccatgctgcagcctctagccgtgtgctgtccagtactgtagccactggccctatgtggttgtttggcacttgaaatgtggctagtggaaactgatgtgtgctataagtgtaagatagataccgtatctcaaagatataatgtgagaaaacctgtaaaatgatcacattcatttttatataggtttaacattgaaatagttatgttttgaatatgttgttaaatacatcataaatgttactgagttgtaactatgtgattaaaattgatttcacttgtttcttttgacgtttcacgtggcagtgaggaaattgaggttccataggcagttgcattctgtttccgtggaacagtgctgttctctgtgctatcccgagccaccagtgactctgagctgtaagggtcttagatcccatgatctggcaagtgggagagggaggtagaaatgagtccctccataccttcaaccagaacttcactgcatgttgcaagtcagggaacaaggcttgtttggggtccttttaaatacatctttcattaaatacatttggatgtaagatgattatatgcctttctagaaccctgtggtgctctcttcctcctcagacataatgtctttggatactaagggtgcattgatgaacagaacacagggcctgttcttcaaagggggagaaaagcttgtaaaatcataattttagcaatctaaaaactacatggtgacagtgacactaataccatcagcattgagcattcacaaagggtcacaaagggtcagctactatgctaagtacttgcactcattttacccactcagtgacacctgtggagaagaaccgaagaaagcaccttggggaattgcagcattgaaggcaaacaaagagagacgattccccatgagggagatgagcagtggccagagagataggataggaagtaggaggcgttacatgctggaaggcaagccatgtaaatttctaaatgaggggaaagataagagtgcaagcatgatgcaaacggaaagcagttgaagtgtagtttttgacatggtaaaatcatgtctgtcatgcagactgaacacatgtcaaatattttattcaattcattaatgagatgaactgtaagatgtgaaaaatggttcattttgacttggagagatttaaaattccttccccagcacacttgagttgcatggctatgaacaggaatcatctggaattatctggaatatcgtcaaattatttccatggtacaggaacacttgcattgctatggggtgtctgcagtatccatctttacaaagctctaagggtgtggaatagcttgtaaggatgtaagtaataagggtgtaagaattttaagggtgtaagtcgtaaaatagcttatttagtagcaagtcaactggaggaacatgctgtagaatcagataatcctttccccgccaccctcagggtctgcaagacaacacctgcatttcaatgctaggacacccagcaatctcttttgctcatatcttgtttttggacatttgtatgtgtgtgtgacaaaacattgttaggatctggcaaatagaaggtcattgttgaccctgtggaatagcatggggagaagttacgttgtagtccattgcaggaaaaacaacgtgggtcaatggtgagtcagctgtggactcctggaggaaagacctagaggcaaaaagctttgaggtcattgaagacaaaaggaaaggctttgtgattttgatttttaaatggaaggaatttgggcctaaggaagcttaaactaaactgtgggaaggactgatacccatcctaagcactagttgcaggtatctcttaagaactaggttttggccgagctccgtggctcagacctgtagtcgcagcgctttgagtgagaggatcgcttgggcccaagagtacaaggttacagtaagctatgactatggtattcagttctgtaagaactaggcagaaaggagatccagtggatatgtgattgcctgggtcttggaaaggggagggaacatctccttttctgaggaagaatggggagatagggtgggttaattaggcagtttcttttgccaggtgataaaaaccccctaaacaatttgtattttatatatggagaatattttctcccactgatgggaaggatcgtagtgtgggggatgcttacccaatttcttaaaaatgtacacagaaatgagatccctaggtgctggaaccgagggtcagtactgcctagaatttccccattagggtctcttttgtttctgcttaccttcctgctgtgtgtttactccttttctcctgctaagatgggtgtcctcaaggagaccagggatgttggtagccacgacctctggtagtgttagtcctggtttggcatcccaactttgttctgcccatgggcattatcagggagtgcttctggttggcactgctttgagttacacgtctgcccttggagccaccaccgtatctgcagggactcagtatcaggactagcccatcttggccttgtgggtgtggccgtgtgatgtggggagaggagctgttgccagaagagggatgaggaatggcatgggcaaaatagaagaatgaccccagtgctgcaacacagtgggtatggattagaaaaggcttgtaggctggacagggcgaggtgagggagtgcatcatgcattaggattttaagtggctttttggggagtattgagcaggtggcaggggagacaagttcactcagaagttttagacagtgttgacattttctttcaaattgtgcatcttgaattctctagaacattctttatagatatttcaggatcttcctgccactttccacattgtagctattctggtgtttttcttttataattagaaataatgaatagttctcatttgtaggcttggattttcatgcgtgtgttggaaagtgttcgttttgccttttttttttaacttcatgtttttattttttaaaccgtattgatggattcattgctaggaacggcaaggaaaagaatactctcacaatgttaccacgtttccttctcacaggttttataagttgtattatttttatattttcaaagttataatcttaccatctcctctgttgccatacttctcattcatagggtctgtctttaactggactcattgtttacagctagtcttttcatcagatcatctcaaaccctgtattacattaatattttgattccgttttgttggatgactttcatcttaatcattcttattgttgaacaatgtttttcttattattgaacaattgcttcattaggtatagaattcctggttgatgggtgtttgattcagcaccatgaaaattcacggtattctggtatctgtcattgggcaaattcttcttctttttttttttttttttttttgaaaaaaatgcgtggaaaccattagttaccattgacagagctactcatttaatgattttttttttctcccaatagtggtggatgaattttttactttgcgttctcactttgtgtctctcatgaccaaaatattttagagataactagctggctaagtctgaggtggctgttaacagtctggtcctaggatagaacaaaaccaacagaactcatcaccgtcacgtcgttttgactttttgctcacaagtttaactcattgtttaatttgtttttccaaaggattgctttgcagtatacatgttggtgcatagcttaacatgatgataaatacataactttgactgtgaattatctactctgctcctttcatagtctcatgcttctctgaatttgtattttgtgttactgggttgttttgttgttatcattcatagtgttttttttgcccttgattctttgatccaggttttggtcaagggcaaggttcaagagaaaaagtaaaaacacagtcttttatttttgctcttggttataaacccttgtaaagtttgattgagaagataacttggatcttatggtttaaattgagtctttgtttaatcccaagtcttccaaattctttgtgcttatgtattctttcctctttcccaatcgtaatagttttgcttctgcctagtcattggtcaaatacctgcctttcaatgcatttaaaaaatattttgtgttagcaccatttgagatttttccccccttttttttcaagtatgtattgaggactgttatgggatgaatgtttgtgttcccccaaaatttagatattgaaaccctaaccccaggctattcggagatggtattcggagatgatacctttgggaggtgataactgttagatgaggtcatgagtatgtgcccccgtgatggaactagtgcccttataagaaaagataccaaagagcttgcctttttctccctgctcaaacgaagaagtcacataaggacacagcaaggaggtggctgtctgcaagcaaggaagagcggcctcaccagaactcggtcatgctggcaccttggttttggacttccagcttccagagctgtgacaaaagacatttttgttgtttaagccattcacagtaaggcagcattttgagctaagacaaagacctactgtggcttctgtaggcaaaagccctacagacccaaagtgttgtgagaattaacatttctagggatcatgccttacagtggattttatccaacacttagctctgacctagagcacgctagtcgtcgttaggtaaatgcttgtggatggtagtttctggcacagagattggagcggtaatgggcaggagttctgtatccagcttatgctgagagagcttcccataaaatggagcctatactttccttttgcagagaccatttctatccattgatagaattcttttttttctttttcttttttttgacgggatctcactccatcgcccaggctggagtgcagtggcatgatgtcaacccactgcaacctctgcctcctgggttcaagtgattctcatgcctcagcctcctgagtagctgggattacaaggtgcacgccaccacatgtggctaatttttgtattttggtagagatggggtttcaccatgttggctaggctggtcttgaactctagtgatttacctgcctcggcctcccaaagtgctgggattacaggcatgagccactgcacccagccttccatcgacagaattctaaagacatgtttaggcaagagttggtggaatgttggcgtgtagtccagatttgccttcagtttgtttttatccgcttcaaatgcaaaggccatgataattcaatagtaaagtcataaatccatagtatgacttaaaatatttggttgtaatattacaaagtatgcttccaaacacattaagcatgcaaaatccttatattgttctttttgtttagtgtttagggtagtttgtgtgaatcatagatgaccacagtagactgttgagttgttattttcttttgacattctttgatagaaaacagtgcttttcctctgttatttatactagaagcaaaaagtatctctcatagcattatggaaacaactcgaatacaactacgtcaattattcatcttttttttttttttttttttttttttgagacagagtcccactccatcaaccaggctggagtgcagtggtgcagtcttggctcactgcattctttgcatcctgggctcaagtgattctcgtgcctcagcctcccaagtagctgagattacaggtgcccacaccattctcagataatttttgtatttttactagagatggggtttcaccatgttggccaggctggtctcgaactcctgacctcaagtgatccacctgtcttggcctcccaaagtgctgggattacaggtgcgaaccactgtgcctggcagttattcatcatttaacagcataaagtggccacttgctttaataaactattatagtaccaaaattttggcctgaggaatttataaatataaatagaacaaaacaaaaataatattccccttgaaacatattctaaaaccaggggctaaaagttagaattgttagattttattgtcctgtttctttgggatgaaatgaaattttttaaaaaccatagttttggccgggcgcagtggctcacgcctgtaatcccagcactttgggaggccgaggcgggcagatcacgaggtcaggagatcgagaccatcccggctaacacggtgaaaccctgtctctactaaaaatacaaaaatatttgccgggcgtggtggtgggcacctgtagtcccagctacttgggaggctgaggcaggagaatggcgtgaacccgggaggtggagcttgcggtgagccgagatcgcgccgctgcactccagcctgggcgacaagagcgagactccggctccaaaaaaaaaaaaaaaaaaaaaaccacatagttttacttaaaccaaaggctttgggattccagaagaataaaggaagtgtacttcaattctacatctcaagaatctatttcttcccaaatttaatacaggcaaatttagtctatatttattgggcactgttaggtttttgtgtcaggtgttgctgagtggcgggataccattcttggcccataaggaccttataaatctattaatacaattaaattgtgaagaaaatttagaaaattgcaaaggtagaatgaggttgcaaattggagggtcttattctggagataggtggaagctatggcagatttttagcatgaatgctttctggtcaagacacttttagaaaaattagcttgtttccaagagtagattagattggggagagaaggaattcaaattacaaaataatagtgtgaaaagcattgtgggagatcatcctgtccatcccctcattcatgatatcctgaggtgctgtattaagggcatcattgctctttgtcacccgagcagtccaggaaggctgcctgttcagtcttagactgtatcctcacagtcttaaaccatatcctcactttatgatagaaacacacaggcaagtgttgtaagagttacatattgtcagttaaacaagaaattggatgagtccccatactattcttcctcttttaaagagagaacttgggccgggtgccatggctcacacctgtaatcccagcacattgggaggccgagtcgggctggtgacgagatcaagagatcaagaccatcctagccaacatggtgaaaccccgtctctactaaaaatacaaaaattagatgggcatggtggcgcacgcctgtagtcccagctactcgggagactgaggcaggagaattgcttgaactcggaggccgaggttgcagtgggccgagatcacgccactgcactccagcctggcgacagagtgagactccatcccaaaaaaaaaaaaaaaaaaaaaaaggaaaaaaaaagagataacttgaaacaggctcttccagcctctctattcttttaataacatgcagtgcacttcttggagctaggggctagggtctaggggcttcttgaaggtgttgatgtctctggtaacttacactgcagggcaggtctctggagggaactttgaacaggttaagcctcaaatgcaggcagagatttccaattgggaaagttaggtgaacgtggctttatcatctcttttattggtttatgggtattttctctttttcctgttttctttcccaccatttaacattatctgttctctgcctttttaaccttctggctttaaatgaacagttgcttaatctatagattaacaggatcagcaaacaaagcacagcagtgcctgcacaaagcagaaactgcctgttagatgagttgagcaaaaccatttcctttgcccaactttctcctctaaaatacataactgaacatgggattcccagacacgaattgtttctcaacctttctttttccattctacagttgtatgaaattaaaattaaataaaaagcaaacaacagaggtagtctttttaatcttaccgagttggaaggtatactatatacattatcctatggtagaaggtctggtacattcttgaccattattactttgctatgggcacccttcacccttgtaggctgaaaattggcaaatcataggcacgtatacattgtggttttggaatttgaaagatctcaaattcatattgagtgagacagtttttgaatggagggatcaggctgtctatatgtggatatattttatgcatttctggtctgtataaatgtaaggattgctttactgaccgtagatttcttctagggttaaaaagttgaaggcagtttggatattttaaaataagaaaattagccctacattgaaagagagaataggaaaatctaggctatgtgtacacatctgcttgtgttttcacaattgtgtcctgtcctatttatttttatttctctcccatctcttccctcccacccacaatttgtttttcattcaacactttgaaattagaatagcttatctatcaaacaaggttctttgacaggattttccaactctgagtatgaaagtgtggatataacaatatatttatatagaatgtcagaagcagagtttggccagattattgggaaatattctaacgccctgcagcattttaccgcctttgcttttacataaggccatcatttggaaacatagcatgctgatacctcccattattgcagtagcgtttcatcagctgcacgctgcctctcagcgcctcattaagttgcaagcagagaacgttttcgttttccagttctctttctcaattaagttagagattgtattttcagtattcctcattattaaaagaatttttgttgagaatagtttaagatgtgatatttctttgtattccaggaaaatttaaagaatgtcattgaaatccagaaacagaagtatatattgtctaggacatgctttgtcttggtttatatgcctaagtccgagtagtttaaaatttatgattaatatactctttgaatgcttagaaatggcatcgattttagttgttctagtttcatcttaaataaattggagtaattactaactcaggattatgatgtgctacacataaaacatttgcagtgatgtctggtacttaggaaaccctcagttatgacatttttcttactttcttcttggatatgttctttgaaaaagggactggtatggaaaagctttgagacgatgaaaatatacaagataggctatctctgaaacaatttggtatagagcatttgattctctgtttcatgtatatattcatatatgctagctgcagtcatgcagacacaatttggatctgggtttttttttttttcctttttcacatgcagttataaatttagaaacctggctgtttcctctggactaaatgtatttatttaaattttcagtgctttaaatgcaaaattacaagcatatgtacaagtagaaagaatagtaaaatgaaccctcccatctatctgtcactgaattgcagtaatgatcaaatctagtcagtcttgttcctgagtcagtctggaatgcaggttttttcccttaactattcaggttctccagcaatcctggcaaaacacatgcgggtttcagctcatctctttcagtgacctgtaaattaagatgtgctaaagcatcacatgttactcattgacgttttgttaatatatttaaaacattttattagtaccacataatttttagcgttttcaaaaagaaataagaatttggctaaaggtgaattttaaaaattgaatgactaagtagaaaagtaggcaaactgttttcagaattagtagcaatttccaattccatttactctgttcattaactttgttttcagccttttgttagccatgtttgattttgtgtttttgaaatacctttggtcattttaggacttttggcattaatcacctgtcttaggtggcctgtttacaaaagggacttttcggttctccatttgcccttaatgttgggaatagagacaaagtttctgtaggactctgacaacatatggctttacaaagtttttttttaatatatacatttctcttcttggctttcttaaatatcatcaatgtcttttcttgctttacgtatttagcaacttaaatgtcatcttgtctgagatcaatatatttccaacttggagagatagtgagaagagagacttcagatttttaaaatgtggaacaaaacattctgatggtgaccaggttttaaggtatttcttcagtagacaaaactacttaggctaccgatgataagcttttaatattaataataattattatatataaaaatattaatataatatgatctaagattgtttctattccccctctttcctggttgttaggatttggaatttcttatgcactctttttttttttttttttttttttctgagacagagtctggctctgcctcgcaggctggagtgcagtggcgcgatctcggctcactgcaagctccgcctcccaggttcacgccattctcctgcctcagcctcccaagtagctgagactacaggcgcctgccaccatgcccggctaatttttgtattttttagtagagacggggtttcaccatgttagccaggatggtctcgatctactgaccttgtgatccacccgtcttggcctcccaaagtgctgggattacaggcctgagccaccgcgcccggcctatgcactcttaaaattatttcatgtactgatacattcactttcaatgataaaacatggctgtatgaccaggtaggtaggctgcttttcagactcctgtactaactgaatgggccccattagcccaagtgagagcttaacttgtcactcttcctaaatgccttcctcagctgagtgcttatttacagtaatctactgcttatagcagatgctatgatttgtataagctgtccatatctacttggaagaacaatattgaaaggcattgagatacttactttccctcaaaagcccataatccaacaactatttagaatatcttatttaagagataggtttataatacccaaagggaacttaatgtatactgaaagtccctgattgaatggattctgaccttaaccagaaatattaattacatgcttatcagacacttactgtgctatcccagggtttgccactgttgagggaacaccagatgaatcatattgtccctgccttcaaggattatatattctaataggacagacagcccatcagcagaataggaggtagcaagtggtcagggatcagataaagtgatcaaggcaagtggaggatgcagtggtaggacagaatggtctgcgcacagagattgagggcatcatgtggtgggaattagtgaactagcatgcaagccgggcctttttcttggcttttgttcaattggaaggagcataaagctactaaaggagcttatgtttagaaatagggcttattgaaggggacaaggcatctcctagaatccaaatgcacatcccaagacttaaaagagttagagggcacaggcaggccctgtcagatccggtctctgccagatccagtcttgtctgtttctcatcttcccttgtctctctgagtattccctgttttcctttcctggactaactgcttcttccagatgcctagtttgagtccacccatggttttttgggggcttttctttgtttttttgttacgttctgtttttgttttttgtttttttgaggcggggtctcactctgttgcccagactggagtgcagtgacgtgatcccagttcactgcagcctcgacctcctcgcttaagctgtcctcccacctcagcctcccgagtagctgggactataggcgcaagccaccatgcacccatgggtgttgacatgccacctgtggctcagacttatgctcacctccagtcaagtttcttccttatctaacgacagcctttgtgtgttcgtgaaagcccttgagggaaagaatgctacgtacagtttggttttcttgggctctaataagctatagggatggtgctgcagagtttgaaatacagtcactaatgagtcctccttcagagagctgagggtgggagcaccacataaaaggagttgggggtcagcagcctcctgatagtctgaaagccaaagatgatggatgtggggctccacggggaggctataacatgccacgttatgttttctgcccttgaggaaagcttcttttcaccaggcaggcagtacagatacaaacttaatagcgatgtgaggcacactgataaataccagaaaacattctgtaagaggggttagcattatttcactgtgtgcagaggaggtttgtccatgtggggggaccctaatgggcgtaggcatttgaagtgtagtctaagggatcttaggtaagagtgtgtttggaacacagtgtacgtatttatacagcaaatgctctgtgtggctataatttaggaaaatttgtaggacttgaggacagcttatttttctactagctgacagaggcttgggtttgcttctgctttaagtataagtatctcgagtccttttttaaaaaggaaaatcaaggaaatagttggaattgggtttcacataaaaaacattttagaaaagaaggggagtatgagagttaggatttgctaatgtttgctgtattagcaaattatttgcaatgcttgtcatattagcaatacatgtatgttttggaaaacacatgcaaattaagcagcttaaggaacttttatctttatttcctatgtaagatttgagatgctgcaaagaaaatattaaaacattgaaccgatacttacagtagtcctcctatatctgcagaggataacttccaagacccccagtgaatgcccgaaaccttagatagtaccaaacccaatatatactatgtttttttcctataggtacatacctgtgataaagttgaatttacaaattaggcacagtaagtaattcacaacaactaataatagaatagagcaattatgacactacgccaccatcactactcttgcactttggggccgttattaagtcaaataagagttacttgaacacaagcgctgtgatgaagtgatcaatggcaggtagcatgtacagcatggagacgctggacaaagggatgattcactttctggactgtgtgggtttgagatttcatcacactgctcagaatggtgcgcaatttaaaacttattgttggctgggcatggtggctcatgcctgtaatcctggtactttgggaggccaggacaggaggatctcttgaggccaggagtttgagaccagcctgggcaacataggatgaccctatctctttcttaaaattaaatataggccgggcacggtggctcacgcctgtaatcccaacactttgggaggccaaggcgggtggatcacaaggtcaggagattgagagcatcctggccaacatggtgaaaccctgtctttactgaaaatacaaaaattagccgggtgtggtagtgggtgcctgtagtcccagctactcaggaggctgaggcaggagaatcgcttgaacctgggagatggaggttacagtgagctgagattgcaccactgcactgcaacctgggcgacagagtgagagtccatctcaaaaaaaaaataaattaattaaataaatagaaaaataaaactcatttatttatagagctttctatttaatatttttggactgaaactatggaaagcaaaaccacagataagggaggactactatagttatgataaaaatcaggaacttaatctagccacgagaacatttgtatttctgatgaaatttttattcttgtctaaaatgttgaactatatttatatttatatctttaaatataaatgaactatatttatatctttataaatgagctatatatttatattttatataaatataaatatttttatatctatgtaaacataaaaaggctttttttcctctctggatgtttactggggttatttaataaaaacctagggatgatattgggaatttttgttggaattttaaattttaacgtgtttgtttctttttttgttttgtttcgttgtttgctttctgagctgggagttggctgtgcatgtggcagttgctttatcaaaagggtcttgctctgcttcagaagaagttttgttaccttgattgctaatgttctcccccttaaataaacctcctgatgttggaacagcaaaattgcattatgtttggaaaatctaaattaataatcccttatctctgaataaaagtaactgaatcaggttgaatttactgcttccattttaataggacagtaggaaaaaactatgcatgggctttatgtggttcaaatttttttttttttttttttgagaccgagtctcgctctgtcaccaggctggagtgcagtggtgtgatctcagctcactgcaacatccgcttcctgggttcctgcgattctcctgcctcagcctccggagtagctgggacttaacaggcgtgtgccatgacgcccagctaatttttgtatttttagtagagacagggtttcaccatgttggccaggatggtcttgatctcttgacctcgtgagccgcccgcctcggcctcccaaagtgctgggattacaggtgtgtgccactgtctccggcctggttcaaattttgtaatctccacatccatctgcatattaacaattgtcattgttggtgttatagagagagaagctgaagcacagaaaataacacgcatgttctagatttcctggtgggaactggaagtaaattctgtgtttggctgatcactgtataaagttctagtactagtctttagggaaaagccccgtcttcatggattttaatttgtcaatttgcaattctacctacttggaaatagtcaacctaatcagttactgccctgttgcaccaactattaccataggaatctgaagatggtatgcaaccaacatgaaaaagagatccttttctcctggtaatcagtttgtaccctacaaacaattcgttggttttaagttgtatagagggaaccatgatgtgaatatgcctgccactgggtttatagaaaaccgatgactcctgaggaaattctcagcagggttgtctttcagtgaaaagaaccctttagaaagatgcagtaactcacactttactgcacataaagtcatgtccctcagggtggactctcaggtgtcatacagtttatgactcatgagtgctgcagctttgtgatctaataaacaagtaaagacggtgggagaattatattcctgtacaaaaagccacttcacctttcattatataggaaaaaagccatgggaatattaaatttttagtggcatttttagagcattttctgtgatctaaagtgcctgcattgagatattaagatacttaagaacaaagtaaaataaagagaagtattaatagcaggatccctttggagctaggttactgtggcagtggtttcaagaataactctctcagcacccaccccaggattctgatttagagatttctttgtgtgttctcttagcatatacctctaccactgagtttatcccctgctgctacactgattgataccttatttttaaatttttgtttttaaaatagacggttttttagagcagttttagattcacagaaaagttgagaggaaggtacagaggtttcccatatacttgctacctgcacacatgcttagcctctcctattataaacatcccccacagaatggtacatttgttacaatcgatgaaccaacattgatacatcattagcacccaaagtccatagtttccctgagggttcactcttggcggtatacattttttgggtttggacaaatgtataatgacatatgtccatcattgtagtaccatacagagtagtttcactgccctaaaaatcttctgtgctctatctgttcatcctccccctgcccccaaccacccaaacccgtggcaaccactgatctttttagtctccatagttctgccttttccagaatgtcatatagtgggaagaatgtcatatagtatggagcctattcagatgggcttctttcacttagcaatattagttaagttcctccatgtcttttcatgggttcatagcccatttccttttagtgttgaatgacattccattttctaggtgtgtaccccacagtgttatttattcattcacagtaccttattttttaactgatttttttggggtctgggactaaggtgaggtaaacaaggcagtcaggaattgagattaagaatttttaatgtaatatttttaaaaatcaaaattactgcaaaaaaactccatgatgaacaaaatatcaactttttagacagagattgagtcacgctcaattgacatcaagccatgcatagttctcctactgccttattaaaatggaagcagtaaattcagcctgattcagttacttttattcaaagataagggattattaatttagatttgtcaagccctctgaatgtcatggacaattgtgagtgaaattccgtgtatcgtctaactccccatggatgttatcttgctcagaaaccttgttctccctccaaggaaggcactacttctcctgtagccttctcaggtcgaagttcttttctcaaaatcctcacagcgttgcccctagaggtgggaatgtcctcttttcctcttcatttcctcttttcctcttcatttttgtttccaaaccactcttcctttctcttccctaaaagcccccctacctcagcttgaagtgcatgctttcagacaaatcactttgctcctccacctgttggtcatctccagacctctttctacctcatcgatgttcaccattcagactttgaagattttagctcctgccttgctgtcatcaggtgtagctgctcatttgctgattcttaagtgatcctaatattgatctcaatgatccttccagtattccaatttgtcagttcatgattctcatccctccagtgaccttgttttcatcattctccatcacccattgcttacaatggtcatattatactccttgcaatgaccaatcactgcaactcctccaaaattttaatttcaattatttgactctccaagtactacttattaccacctcactttctccagtcctgtgcgccatacattctttagcccctggagtgtgatcagtggactcagattccactggtccctaccaccttttacctgtgtctaattcccctcatgttctcacttttgccacttgagattgcatggcccagcattctaatcattcccttgcttataccgtcacttctctattcgttgttatttatctggcaaaacaaccaccctgttgcaatgcaaggtttatgcaagggaatgcacattttcgaaatagatttttatgtttatgtttttctttcaaatctctactcattaataaatagaagtggtttgatatttcacaaatgtgatttaattgatcaagtttcacatttcattctaagtgctcagttaaacaccatgatgtattcacaacagtaatcaaagcaaggggctgtagttagttataggagcaaagagaattcatgagtttatttttatctaaatgacacccttgataacttttcgataagttattttcatgtaaattacttggaataagagcaggatttttatatagaaagctttctatgtgtcatatcctgtaaaatgtttgtccgattagtgagagatagggggaggttgaattttactaaacataatatccccagccatatctactgtaacgtttgtttaggacattacagactattatcctacaccaatttatttcacatcaaaaatcaccccatgcttgtaagaatcctcctttccccctcttgtttctattttagctcccctggaaaaataatattttaagtctaaatgagtacaataaattaaaaagttgcattgcttaatattttgaatggaatagctagatgcttgttcatttgctatctttttctttgtactgaatttctttagcttggtcagaggtagagcaggcttgactcttagtggatagtggtataggttgagtatcccaaatttaaaaatccagagtccgaaatgctcaaaaacccaaaactatttgcatgtcaacatgatgctcaaaggaaatgctcattggagtattttggattttggactttccggattccagatgctcaaccagtaagtatataatgcagatgttctaaaatcggaaaaagtcagagaccttgaaagcacttctggtcccaagcattttggataagggacactccacctgtaccttacagtggaggcttgttagatgcttgtaaatgccagcccctgcctcaagtaacaattgattctttttgtgtgctctcccaggtctaccctgaactgcagatcaccaatgtggtagaagccaaccaaccagtgaccatccagaactggtgcaagcggggccgcaagcagtgcaagacccatccccactttgtgattccctaccgctgcttaggtgagccggccggccgtggggctggtgttgattgggggcctggtcttgagggaagaaaaagaggatgctcctgttaggtcacatacacagacttgttcttcagcacattgccactctgtgttgtactgtgttttggactcttgcagttacattctgtgcactgaccctataggagcagtatttttgagttccctgcctcagaatgaatttacccagggtgtatattgaaattacaaattcctgggccagttccaggactcctgaatgaaaaatgcctatagtagcggatccgggaattcttattttaccgtatcgcatagatgattctcatgaacaggggccttgtgtgtttcttcacatagactttctagaagaaagaatctaatgtgaagctgcagcattttgttaatttctaaaaaaaaaaaaaaaaaaaaaaaaaaggctgttctacaataactactcctcttatttggtgatagtagaggaattggaattgggaaggctttttttctgcttacatcaaactggaggaaacagtctgattactaatgtttaatgtttgttttgtcacaaacctcaaatttacctcaacattttatttaaaaaaattgagtagttttatgtggtatcgtgctcttttcctctggaaactgtcatactccatatttaatctaacttggttattagtctgttcctagttgttgtttttatgtgaccagtcattgcagaagtcaagttctttgctctggtatcttacatctagatgttttccacaagtgtattcatcagtaggcaggttgtaaataaggatatagagattgtctgtggagattgtggacaaatattgatgtatattctgatgacttcttataaaggttaaaaggaatatttcaaagaaaatccaacagcaaacttacaaagtaaggatatttactgaagattccggagatctatgtaatatatggtcaaaaatgaatgtcctaagagcatactgattgctgttcattcatgtgcataatttgagacataaaatgaaaacactgggcattagaaagaagatttcacctggtgaatttacttacaatgtaattgatgaagagagtgtagaaaactagatttcttaaacatctgataattcaagagtttcctttttcctccttattccttgttcctatatgctttataaggcctcaactcttttctggttcatcaaaaagtgcagtttaattagatgaaaataagcagcacttaaattctagatacagaactcctactcaaaaaaatatagaagtcatctgtccccaggaactgtgtattttatactcacttagttattacaccaagaaataacacacagagattgaacaattcagtacaagttaggaagtagatcatgagtctgttaatttgatgggccaggctttgttaatgatttgtttcttttggttcttacttacctgttctatgaagtattccaaatatattttcattagaatgtaagctcactgagaacaggtagggctttggatgggcattattgctcctggtatgacactcaaaactgcagtcatgtttcagaagtgaacttatcattttacatagatttttctgcttcatattctattcagaatgatttgtattaaagttgatggaaagatgaaatccacattaagattgttatttactacctagtgccagttgttgtagcaaatatcctttgaaccccaggtctattttatcctatctgttgatcacttcctttgcccctgctcttcaagcctcctcatctctgaaaagctctccttccactgggtgtggtggctcaagcctataatcccagcactgtaagaggccgaggtgggaagattgcttgagcccagcagttagagaccagcctgggcaacataatgagaccccgtctcttaaaaaaacaaaaacaaacaaaaaaacctccaagtgaacgaacagtacaacaagtaataaaggatataaaagatgttctcagatctcaatatcaagtcagaagattttataataatattataattacacggagactgtccaaatatttgtatttgttgtgctacactgcattatgcaccatttagggaaacaacagcctaagtaatgtggttttaaataattaatctcatctaccaaatacctgtttgatagtaaagttaatgacctgtcctcaccttatgtttttaaccattatggaaagagaaccacttgaaaatatatcattccactgacagataattacccagctgtgaagcacaggctggagactggcaaggagaaatggagagaagcctataaaataattctttctcagggaaggagtttattcctgccaaggctttgccatcaaccattatcagatttctctttcatcctccgaacagattctgggctcctttgatgtggaggtacataattcaaaaagttgggtcacttgtgacatgttaagcaaatttctcagttctggttgtgtctgatgtgaaatgagcacgttgacactaactgttcttgactactatgggactagataatcatttgctatttcctgtaggtacttggcgtgttgaatcattttaccatattttctcattttatgaatcactggtccttttccattggacctgaaattagaccctaatatgacaagtagagcatatgttgtctcttactttgttattaaccttagattagaattaaggaatataggtgctgcttttttcttaggtagtggcaaattttccaaaggtctcaagcccagagtataatacagagttgataaaataacctggtagagtatgtagagcatgccttgtctttcaggaaaaggaactgaaaaacataggttttccaataggtgtaacataggtaacatagggacataggtgtaactgatgtacattttacttgcacttaatagacaggcagtgttagttcttcgtctctcttcacaggctatacaactaccaagatccagagaggttgaatttcttgctataactcacagcaaataaatgggagagtcagcactacagtccaagctctcttgattattggtccagtgttttttacagtatacacaaaaatttgttttaaaacaaatattcactatgaattagagacaatagcactaaaaaagaaactcacagctatcgttgtgttgacagaggagacaaccatgacctagtataggataaatctccatgtgatatgttttctactttatagtagtagtaggtaacattcttacatattattcctgcttaacaaagaattactgttcagcattaacataagtatgctctaaaatctcttgactgtatccaaatatatgttttagacaagagtttttttttttttactgacctagcaaacaaaataaaattatcttaaacattaagcgtgttaaaattcaaaacaaagcttgaagagagaaaaatgcttgttatgtgtggcatacaaccttcctaacctctttatcagatgaaggatccagtgtggcactggattatttttctgtaatattttgcctcggacatatgtgctatacatttcttgtctgcatggggaaagtatgtcaggttgctgttgccactttcttcccatggagtggataatttcccttgagaataagttggctttctcatctcaccctttgcttttggtagtacctctggaaccagagggtaagattcatcttaatcatgtgaacattttattaattatctcatgtgtgattcaagcacatcattactgttactcaaggagaatattttctttgcaaagctttcaaccctttccatttgaatgactgctcttcatggtgtaatagatccactgttgaaattggcacttttctgtacttgtctctgaccagcaaaggcaaggaacattgcgtaaaataaattactgttgaattattggggcaaagtcaggttaatagcttaatccaaaaaaggaattacaagtgaaagaattttaccttaaatgtcattctgtttcattttgtaattaagaccttccaaatgtgtaagtagtaatgaccagaaatcttatcagatatggtcaaatgagaaaggtattcaattcatattaattttgaattttattgttttaatacaattttaggaaaagcatgccttgttttctgggtttcttggctgcctttgtatcaattatctacagctatcttctttagcatggaaaggatgtatttgaatactgtgacattttataccagggtaattctttgaatttatgtaaacaacaactctcttgagacacatcagtacaacacaatagtcagaaatgtcacatgagagttcaccaaactttaaagatggcgatgaggatggaaaaacatttttattgtagactttaaggatcttgtaaatccccgtatgtaatccagtgtgctagagaattggtgcccatggcgcctcctctccccaccgacctgcactgtggaaatcctactaattttgaagtcatgggagatgcatgtgtgggacctatacatgcactgtgatgagaatgatgacttcatcattctcattatttaatgagcccagctgctgcatacaagaaggatgcaaattcttgaatgttcttgattgtttacatcatggtctcataaggaatgaccagaattgctgggcatttcttcatcaggaaaggctaatcagccatccttggagagacatcagactcctttatatgtggccttcccatgggacctttgaatggtcaacgttaatcatgcttcagaaccagcatactaagtaaaagaaaacatgtccggaaaagaaatcttatcagtgtttatctcccaacagtgggattacaggtgattttgattttatttaagcaattttctatgactttgtataataaatgagtagcttttataatcagcaaaagatagactatgaaatcagtacatataattttgtatttgtatgtagtaccattgaaggataatagaaaaaagtcaaaagacttgaaagtcgacacagaatgatcattaatttgttttatctcttggtagttgtactttatgagctttatacatacagtatgggaaaatacactttagttttgaaaacaccatgatgccaaaataaaagaaaataacgttcattcatacgatcttcaacaaaatttaagcagcattaatcatcactgattcttcaggaagattcttgatcttccttaattttttttccctccaaaattgcatatggcagccacatttgtttcaggccagaaggaagaatgggaagagcttacatttatctcacagattccttctgggtgaggaagacttagaaagtgaagccctcttccatttgattaagcaagaacacctataaaaatggtgtcttcggccgggcgcggtgctcacgcctgtaatcccagaacttcgggaggccgagatgggcggatcgcaaggtcaggagattgagactgtcttggctaacaacggtgaaaccccgtctctactaaaaatacaaaaaaattagccaggcgtggtgcgggcgcctgtaatcccagctactcgggaggctgaggcaggagaatggcgtgaacccgggaggcggagcttgccgtgagccgagatcgcgccactgcgctccagcctgggggacagagcgagactcagtctcaaaaaaaaaaaaaaaaaaaaaaaaaaaaatggagcccttctaggtaggtcatcctccatggctcactgcagcacttccttggccctgtcccaagttccataattgcctcaattgcattggctcctgcttgatttgctttctaaaactcaggacagaggatgagttgaggagactgacttttttaacaatcgcattttgaaaagaaggaagcgtagtggtgtttcttggctccgtttccagttttgtttcttttcattttaattattgtacctggtattgtgtcctctttctgggacttttaacaactaatgttttgattgataagagctctaatagcatgggtgatttatacttcattacatcttcagttttgtcttctttactggagttgtattcaggtgtcattaagtaacgaggcattaaaaagaaacgataacttttgaaaaactgctgttatggcttatgagtgggctttgctgatattttcttgaagcacagaatttatctatctctgtaggtcctagatgataggtgagaaaaagaaacccagcttatttggcatgatattgtcccaaggcttgttagtaattgctttgaaaaatgaatagcaaggctaatggacatctgatttgtagtacatgctaagaattgcaaatgtgtgctcaaaagaaatttctctgattacaaaagtaacatatattcaacgtacaaagttgagaaaatacaaccactagctaaaaataatcaaaaccatttggcttccttgcagtctacatttttttcatgtatgttttgcttttgtttttagtgttatttaatcgtttcctgttttgtgacttgctttttacacctaacatttttagaatactctacctgtgaaattaaatattcttggagagcataatttttaatgtagcatcacaccagacactgtaatgtgtttactcttttttatggtcatttaggtggttttctttattttgtggtggtgtaatagttgttataaatgatgctgtgataaacatcctggtagataaatttgtgtttagttgatttttatataacagttattggcggaatgccttgcaaatcttatagttggtgtaataaaatatatgcgccacataattgtttatgaaaatatggaggaaaattttaatactgatttatgatcctgagtttaacataagcatggatacccctacatttagctatgatttttttattgatagagtaaaagcgcctgtaatttctacttaaggccatttaaaataattactatttaaatctatttaaacaattttaaatattgcttttccaaatttccaccttaggaagtagttaattgaatattctcagagaaataagtcctacaaaattgaccaataaaaggtcagttacgtattcattgtgtacgttttattgatcacccacagtgtgtgagcccctggaggtgggtgaaatgtgggcctccctcttacagagttgatagtgggcctgaaggggatgggatttcagctcaggaatttaaggaagacttgacaggaagtagcattgtgagccaagatttcaaggataagatttcaaggcaagaaaggagatgtattttaggtattcagacagagggtcaacaaagtctttaaggtaggaactagttcacttttcaaaaagaagaggtaattggtcatgataagagtagtagtttttaaaaatcattactgttttcattcatttataatgaatactattattttataattttaaagtttatatccaaataattgttttcaagatggtaatgaatgtatattgcttttatgtatacacatagtactttttgctttttggtaactaagtttataatttttgagggcaggaaatatttttgtttttcacttacaaagaaactatattttaataagagttttttgacagcagtgctttatgccaaaggaaaataaagcaacatttaacatatcaaagaaagccaatgcaaaacaaggattatttatttatttatttattttattcatttttgagatggagtttcactcttgttgccccggctggagtgcaatggcgtgatctcggctcactgcaacctccacttcctgggatcaagcgattctcctgcctcggcctcctgagtagctgggattactggcacccgccaccacgcccagctaattttttgtctttttagtagagatggggtttcatcatgttggccaggttggtctcaaactcctgacctcaggtgatccacccatcttggcctcccaaagtcctgggattacagacatgagccatcatgcccagccaaaacaaggattttatattcaatcaaactgacattcagatatgatcacatgaaataaatatcaacgtacaataactcagggcatattttcacattattttcctgtagaatctgctagagaacaagtttcagatacccaaaatacctagagaaaaactgatataaggatgggtaatgagcattaaggagaaacataaaaactaagactcaacgatggtaaaaagtatgataatatagtattccacagctacatgctgtgacaataaagagattctgtaactgtcaggcctctgagcccaagctaaaccatcccctgtgacctgcacgtattcgcccagatggcccgaagcaagtgaagaatcacaaaagaagtgaaaatggcctgttcctgccttaactgatgacattccaccacaaaagaagtgaaaatggccggtccttgccttaagtgatgacattatcttgtgaaattccttcttctggctcatcctggctcaaaaactcccccactgagcaccctgtgacccccacccctgccccccagagaacaaccccctttgactgcaattttcctttacctacccgaatcttacaaaatggccctaccccatctccctttcctgactctttttcggactcagcctgcctgcacccaggtgaaataaacagccttgttgtgacagtaactttaatggggaagaatgagaagaagatgtgggtaaagaaacaactgtttttctattaatggtggtagtattagtgtgtaattctgagcctggtgcataagtaatatggtgtaacataagtgaatagttgtgtgatattttaattcaatcatcccatgtatttgagaatcagaattttgatgtggtaaaagaagattcacatgtaacatataatctattaaaaagataccctgtagtcatgagtttgacttttaggtatcatttctcagtataacatattgttgtagatttcagataacattttttccccataaatactgtccgctgcaggcctaaaaataatgaaaaggcctaaaagaccaactcagtagcggtaaacaccagtactgcacctagattatggtctttaggaaccattttccagtaaaagataccagtaatctttggaaagcaggatttttttttctttttttttttttttgagatagagtctagcttcgtcgcccaggctggagtgcagtggtgcgatcttggctcactgcaacctctgcctcctgagttcaagccattctctgcctcagcctaccgagtagctgggattacaggtgcctgccaccactactggctaatttttttttgtatttttagtagagacggaatttgaccaccttggccagtctggtcttgaactcctgacctcgtgatccacccgcctcagcctcccaaagtactgagattacaggcatgagccaccacaacccggcggaaagcaggaaattttttaaaagctattttaattcagtcatgtaaaaaaaatgagcagaaagaaacaaaaaacttaaaaaaaaacttaaaaaatgagcagaatcttaggaatcacctgcgactttggttattcatgcttagccatttctataggaaattccagcactatttgagttagaccactaattatatgtgtgttgtagctttctccaagagataatggaattcacaaatcaaaactttgagattattaagtgttacaagtgaattataaccccagtcatttgctttcaaatgaacagctaaacatattttgtgttaatttcttatggatgctgctttgtttgtttgtttgtttattgagacggaatttcactcctgtcacctaggctgaagtgcaatggtgagatctcggctcactgcaacctctgcctcccgggttcaagtgattctcctgcctcagcctcccgagtagctgggattacaggcgtgcaccaccacacctagcagatttttgtatttttaatagagacagggtttcaccatgttggccaggctggtttcgaacttctgacctcaggtgatccacccaccttggtctcccaaaatgctgggattacaggcgtgagccaccattcccggcctagataggcttttagttggtttccatatacagtgtatatagggagaaacagactaagacagacactggcatccacagaagtaaaaataaaaagtaaggtataatttaaatttcacacggtcatggtcacatttttcagctttttgcacctatgttgtataaaaaagacaaaaatgcctttagaggctcaagttttcaggacttcctgaagctgtgtcatagtttaaaaatgccataaaaatgccgtcagatttaataacgtatcagctgaacactggatttctgttatgttgagtcttcaaaaatttctccctgtatgaggaattaatactgttatgtctgatctggtggtctgaaatgtgaacttttctgggccaaccagtaaacagctgctgttgctttatagctgcgtaattcagtcttggaaattattagataattcccacaccatttcagcttgctgttttaccataaatttaatgtgaacagtatttctagctaacctcaagctgtgtttattgtcgtggaattttctcttttattctgaggtaaatgattacaaatggttatgatgaggaatcaaagaagaaagtggactttcttcaaagttctttttctactctagccgcttctgagcatctttctcaagcactgtgtttccatcagtccctaccccaagcagagaaaggaaacagttttcccctttgtcttcagaaccctcttctcatcgtgtcattttccaaagcaaataaaaatcttgagatattgtcttgagtttgattttttttttttttttttgagatggagtttcactctttgttgcccaggctggagtgcaatggcacaatctcagctcaccccaacctccgcctcctgggttcaagtgattctcctgcctaagcctgccaagtagctgggattacaggcatgtgccaccatgcccagctatttttctgtttttagtagagacggggtttctccgtgttggtcaggctggtctcgagctcccgacctcaggtgatccgcgcctcggcctcccaaagtgctgggattacaggcgtgagccaccacaccctgccgagtttgatgttttttttaaccattcaagccagtaaataactttccagacagctgtagtagaaaacagaatttgtgtgtgacaaaacttaagattttgggattgagagctctatggtttatgccatgtggataattgtagccagatgaagaatatgaaatttaaggaagtgtttagagtggtacagacagctattattacgattcttggggtagaagagtagcttacatacaacataaaataatggcattaactgaattaacttcagcctttgccatgaaacccaagctttcattatgttttaaataatgaactacattaaaaatagtatataaatatgtaaaatatattagacatagacttctcataataaattatgggaacttttgatgtatttcttccctaggaaaagaactaaacaagtgcttctttgtggacttaaaatttttcagtttactattgtgaattaggtacagcatatctttataattccagataatacccataaaagcagaactgtttatttacttattatgaagggaatactgaaatgaaattaaggacaatttttttctcacgtattatatttttaaaaagttatttgatgtttgtgattaaataaagaatgaatttttaaagccagttctcaattagcactgaggaaaagaatatgctttttttcaggtacacaaataagcatcatggatataagaaacgacataaagatgaatctacagtctggattaagacgtattttaatttcagtgtcaaaggctgttaggaaatattcagattttagtacttgacaaagaaggttctcaatatttgtttcagtgttcagtgaaaggataaattctgtcgtctttctcttttatcatattagtcactgagtggtttcattaaacattccctcttccatatcccctgataaatttcaacttgttggtgatgcatcccaggagtgtctgtctttttttttttttttttttccttctcctgtcagtgagtcttaggctttggctttgaaaccctatagtgaagggaaatctcaggcaacagctgtgcaaccgtctggagagcagctagtccagattggaggagacgaacgaggctggtcgcaggagagaggcctccaggaaaaaatggcattgatgcattacctgcgttaaagattttcctgtacttagcatgcttcttagggttctactggagcgtttgggaaagatacagtattgatggatgcatagaaaatgaggcaaattttttaaatggggcaaatattaactgtagacaaagaaaagccaaaagtacaaaataacagcgttgtaagatacgaagataaaaatacgcctaagtatgagcgttctggcagactcacaatacagatgccatatatggggtaaaaccataccagtaggatggtgggaagggaaaggggtgggctcatgttccatagtgggaagacctacagcggaaaaatcaggagaatagttatttaagcacagagtttagggagtaagttgcagaagagacaactaaatgagatggccgtgaatgatttttatgacctcctcttgttatggagaaatcgatcaaggaggcctatatttgatggcaggaagaagttgagtttaaggtttccagacatttgttttaatctggaaaatttctttttttctttctttcttttttttttttttttgagacagagtctcactctgtcgcccaggctggagcgcagtggcgcagtcttggctcatcgcagcctccgcctcctgggttcacgccattctcctgtctcagcctcttgagtagctgggactacaggcgcccacaaccacgcccggctaattttttgtatttttagtggagactgggtttcatcgtgttagccaggatggtctccatctcctgatctcgtgatccgcccacctcggcctcccaaagtgccgggattacaggcgtgagccactgcgcccagcctaaaatttcttttaagcttagaagttgcaagtcaagttactgttaaaggcgtcctaactttgaattagataaagctaaactgtggtttaattgagctgagtttgttgtatgctatatctcaacttcacaagatgtttgctttttcttggctataacctaagattatacaaatataaaattacctttatgcccatttgatagactttagggctgaatttccctgtgtaagatgttgtagaggtttgtacttgtgattgtttttactctagaagcatgtttatcttcactcctttagtgacacgtgtttgttcaggaacttcaaactcaatgtgatcaaaactagactcatgttccctgaatagtctctcctgactacaaatctgttggaaacttccaatcctaattaataattgtaaactttttaatgtaagtcatatgaggggttgttgtgagcataggaggtagggagatggtagtgtgagctggagcatatggtaaaagttgtttgaaagaaagtagacccatgatgtggatcctgagggatacgtaaagaaaatgaagaggtgtagatttaaaaatgtttatggggcctgggcgtggtagctcacacctgtaatcccagcactttgggaggccgaggtgggcagatcacctgaggttaggagttggagaccagcctggccaacatagtgaaaccccgtctctactaaaagtacaaaaattagccaggcatggtgatgggcgcctgtaatcccagctactcaggaggctgaggcaggagaatcacttgaaaccgggaagcggagattgcagtgagccgagatcgcgccactgcacgccagcctggatgacaagagcgaaactccgtctcaaaaaaaattaaacaataaataaataaatatattcatggggatgttccagggaaagtagtttgtgttggtagccttgagaaataataatagaaaattagaatagaactaagttggttcattaaagttggaacacttgtagagatttttgatttggacagacattaattcatttgattatttctcttattcgatgtccagaaaaatatctgtacattcaatgtggttttatttgtactgcacatgtcattaataggctaaagttacctctaagatacctgctttcttagtccttgttacgctgtaaattctgggcatcaggatatagctttttattatgttagctcttttaatagatgatacaattggattggggaaaaaactgattatactctggagtaatactttcatagcctgtagtatcctgcaaatagctcctggtcatcttcgaattttactagcaaacttgtagggtaataggttgggacaaagtattataatcagtggctttgagggcctgataagaggaaacaataattgtgcagctatattgtgaataagtagtgcatgatgctgatggttaaccctttcctgcggtgctcaaacattgggaaataattgctttttgttcaaaatgtaagctcttcgataattgagacttttgtcaattcactgaaatattcccagagcttgaacatgtctggtacatagtacatatttaataaatatatagatttaatgaatgaattgaggatgtagccaaatattggaaaaggaaagggaaaagaaagaatagcccaaacattagaaagacagaagatgtggagcagcaatttcacatgcctaaaagaatttctgagattatggcaaaatcatttactttacttactccttattgatcaacaaaggaagagcaggttttatgtaacaaccaagaagtaacatagggatctcagaagagaagaaaccaagtgtctttggatcttaataaaaagaacattcaactccagaaatagggttaaacctatcctacacatgtctagtaaaaagtcagtgtatcagaggcatctgtgtttagagataaaacataccattagattcatttataatagtttcattgtccttagtttttaaggctaatgataaagatttttttttttttgtgagacacagtctctctgtcacccaggctggagtgcagtgacgcaatctctgctcactgcaacctccgcctcccgggttcaagcgattctcttgcctcagccacccaagtagctaggactacaggcacacgccatcatgcctggctaatttttgtatttttagtagagagggggtttcaccatgttgcccacgatggtctcgatctcctgacctcaacagatctgcccgcctcggcctagtgctggaattacaggcgtgagccaccacgcctggccttaagaattaattttcacagaaatctgcttctaaatattattcagtgataatagattttagaaatttcagattcttatgttgtaccttaaaggttaggatactatttataaatgctaaacatgaactcctgtcatcctattttaatgtctttattaagtgattacatgaatgtggcgtttcagtaggtgtttggtgtattaatagatgtaggtactcccctcttaaacctttaagtattttcatgccatgaaaaatttggggggcattctctttatttattgattaggtacctgtattttcaagaatattactcagcttcagttcccccaaatcttttttagtgttaactaccttccgagaacgtggtataacattttaaaatatattttttgaaggtttggatgtcactgaagatccccctatttattggatggtatctttatcagctgggaagataattagtttcccaatgttgctatatttttatgaataggtcctgtagctcttgctttcttgaaagcttagaattgattgtaagccatggactaatgatattctccaagcatatttaacatgaataggctcatgttcagtatgtcaagaagttaccctgttgtactatttaaataatttgagcttagttttctttttccacctttgttctaaattcttaggtgagtctgaattcctgggcatctgtgcacacagcttcttcagtaggtcctttactctcattgtatctgatctttgacttcataaagacccttggcctactgaccctgtatttaatttcacatctcaatagtatttagccttctcatatttttcctcttctttagagctccctgatccctcactccagtcattcaactctgtgtattcctttaacttccaccctcgctctgtctcttcacagatatgcttctttatatggtagtcagaagttcctgtgtgatcttcgtaacctccagttccctccacagtcacctgttatcaggcatctgttccttgagctccagggaatgagctctttgctatcattctggttgtcggactcactgggcactgttgtgtcctccacagtctctcagtggcatcggttgatgggtgcattctccccacactgatgtcattctgctgcttctgattttctttctgctgtcctccattttcctttcaggctcccttccccgtcctccccgcgccaccttttgcaatatttaggattcagaaattccaaatattgcaaaatatttagaatcagaattcagaaattctaaatatcagtgtttaataggagtaccctggggttgtccattttctcacacaacacatacttgctaggagatctcataagtgcagtggtttttcagaggcctgcattgatgattcctgagtcattatgtccaggccaggcctcatacatactatttactggttctctttctgcgggtgctccaccaagaattcagactcaatggaatatttcttctaagatgtacaccagttccttatcaaaaaatggcaaattcagacttcttaggttaaacagagaactcgtgaacatggcatatgtctgttattccatttttctctgttggcttattgctgagtaccatttgggataaaaatctgtttcaggcaaaggataggattgttttcagcttttattaaattctcctagacccttgattttatgcagagaactaattaaatttgaatgaatttaatgtagaaaccctgctattgatgcagaaatcaacctgattctggactagcaccagaatcaactatttttgttgtttttgctttctttttttttgcttttgctttctctgccggtaaataacaactagtatgtaagaatcaaatgaatcaagcataaatccctaggaaatatttatgcattcatttttaacaatttaaagatgtgaagatatataattaagcataatcctctcaaagtttgacgttgaaaagtatttcagatacttcaacttaaatatattttttgcaaaatatcttttttaaaaaaacagatgtggtctcagcaatgtaattattacagtgtgaggagagcttacagttgtaccaaaatttataactaggaagaagagaatgtgaaataatccggaaacctacaaaactgtcctatacaggaataccaattaaacagctactaaaaatgagtgtaaaatgacaatatggctttatcaagtgcttagggtctggaaaaatgcacatattgcctgttatttattgttatacttaatgaatgttcttttgcacgtgagaactgttataaaagatgtcttttgtacatacttggtacaccagttggctttttaacccattagctgttttcccccaaaggtggcctactctagatgacgttaaaaatacacattttccagggacttatataaatagtcaactgccctattatggaaacttaaaagcgaaggccctgaaatatccagacagtttgaacataaaccaaaaatgaagtgaatctctagaattgctgtgtaatagcgtgagtggggagggggtccctcaagagagggaactgacctttttcttcctcgtgggtgaccttgagtacacactttatttagtcattaaaagggtcacctgaagcttagagaatgaagatcctacagcctgttaattttatcattgttagaaactctctgcctttggcctgaaaatggtaaatcacctttcttagaagattctcatatccagatattcttaccaaatcagaatcttttccagcattttcttcaaaaaaccacagttctgggttaaaacacagcagatcctaactgtaattttcctttcatgtacattttagtcatctttataattttaaatgaaagacaggaactacattatttgaaataagggttaaccccctctaattataagcattaatcacacacagttttctcatttctaaatgttaaatataaaatgggagctatctcttcagacacttttctgttgccttctgtgtgcggcaggaccttacttttaagcttagtttgatttaaaggctgagtttctgcttgcttggaatgcttgctcttcaaaatatttgctccctggagagggaaactgaagatggagctttcacgtgactttggattgctgacctggaagacgtttggggtaataggatgggctagggcatggttccactgctttctgtttgagtggggtcaggaaaggaaggcggggctcgctgtgtgcaaacaggaaaacatagtctgaagatgtttgaagcctgagtgcactttcatttgatgccttgctttattgcttaagagaattttaaactgccgaatccgcaaatgtgctgcagcctataatgacacatatttaaatgatttttgcatctaaacaaatgcattcactctttgcctggtgtgtacaatttgaatgacactcgtgctctgcctggaaggaacagacgtttttcattataaaattcagtcaagcagaaaagtagcaaaggaagcagaaatttccatttacatctatgattgaagttgtagtgataaaagaggatgactaagttgaagagtagccttgttctcattctgctatctgacatgggatcttgtcactttggtaatagtttttaaacttacattattgaggaaggctctgatcagaagtctcaaattatacatgttcttcaaccttagatttttctgggtgttttgtttcaaaagtctcaaattatatatgttcttcaaccttagatttttctgggtgttttgtttggttttttggttatctatagatagatttgagtatctctttttttcttaaaatccgttacttactagtaataaagacttaagtggtagctttacgctccattatcacagagattcacagtactttttagtttttacttgtgagcctcagcaggtgtagacagataccttagttgccactgataacatccagttgccactagatcaagaaatggttcaaaattctccaggggcattttctgctaaagaagagttggtgatcttccttttggaagccttaatgtacttaaaccttcttccttagaagtccagaaattcaattatttcagctctctgtggagtgataagtcctgccaaattgatttacaataatgaaactaagccttgtttacaaatctaagtggtgatttctaagtccacagaggcgtggtaacagagagagagattctgatttatctgggggtctatccgtgtttgaacagattgtgtgatttttgaaacatgattcaaaagggatgttgataaattctaaaatacatttttattgaagagcttgatgaatcatgtatacttactttatttgttattctattagatattgtcttcctcatccctaggtggtgttgctagtacagtgacagaattcaaatccttctttttcctctgctctaacagagctttgtgaactcatagcaatattgtaatgcctggtaaaaggtggtgccagtttcaagtactatatcctaattacttcatggctaactcttgttattgttaacaatattgttaactcttttgttaaatgcagtgacatcttttttctttctcattctctgtgtactttttgccctaaatagttctgcatcttttaagatacaagtttgctttttcttggaggtttttatttggaaaatgcctgaaatatatagaccaacatttgttcctccaatggttaaattacattgtctcccaaagtgaggcattttaagtctggactatacccaggagaatctaaaagaggcagttaataagctcttgaagagcacagtggggtggttgtgtatttattgagtctcacacttaggagagaaataggctggaccaaatgagcctgggcatcaaaagcatgtgggtggtcgttggtgatatgtgcagtgatgagtgtgtgtgctgagggtcctagaccaggctggcagggaaatgaactgaaggcagtgaagcctcccctgataactgcagagagtgctgcagcatccaggacctcaggatcatgatgaacaagctgtagtggatggaagggagaggaactatgggaaggatgagtttctggccagaaagtggtttactggagtgctgtgtctgagtattacatgatctgaggaccatgaggtccagctttgggagtatggagagtttgagtggagtagagttatagtcccatggtcttctgattcacagacattcatgagcgataagtatctattgagaaagtggaagcatgatttttatgacctcctcttgttgtggggaaatcgatcaacggggcctatattggttgggttctacaaccaaatagaatgtgttcagcaggagtcatgttttgggctcctcacaatgttcagtgttagttctgttcctttctcttgcttccacataggaaagactttgacccaatgaggaattagtcattgtcctttgggtacacttccggaatttgataatcagttgggcacttgattctagtacatttgctaaaagtaattaataccctgcaattggaagcatgcagcaagcgactgggaatgctaagtgaaaggtcagaattgaaagagtggaggaggctgttgacccttaggcatggatgatatgtctgagtgagaaagcaagaagagtagaagacagagccttactttataatcagaattatgaaaagaggagccaatgagagggaaagaatgattggcttgagatagattggtggaaactggagaagattgaatttaaagaagaaaagtgggccaagttcagtggcccatgcctagaatcccagcaaattgggaggctgaagctaggagagttgcttgaggccaggagtttgagatcagcttgggcaacgtggcgagacccctgtctctacaaaaaataattaaaaaaaaaattagccaggcatgttggcatgtgccggtagtcccggctacttggaaggctgagacaggaaggttgtctgagcccaggaggctgcagtgagctatgatcacagcactgcactccagcctggttgacagagggtatccccgtctctttaaaaaaaaaaaaaaaaagagaatgtggcagagtagtcagagaactggagggctgagaagagactgatggcatttgttgttcttgaccttgaaagaagagttgcagattgttggagcaaggccagatggtaataggttggaaagaacaagtgaggggcgtgagagtgacagtctacaaccccgttaagaagttatctgtgaaaatgcctcttcctgtcttgattatagcctccctcgcacatggctttctgagtatggtatgtgaaaacagcatgctgtatatttttaccttcccatatgagttaaggttttggtaatgacttgtggttcttttgcctcacggaacaccaacctggttggtattttgtcggcaattatgtggtttttaaaaagccccgtatataaccttaattaattgcgtctctaaaatctatcaggctttgagttttttgttttttttttttaaataaggcagaaagaaaggaaagtgttaggagaaagcaaccagtgagaatacctatattttgaagaaacaaagtagggaatttagaattatctctactatatctgctttttcagctcatctctcgggatacagaggactgaactaagctaaagtaggttcaagtctaaaggaaaccttaaattaatttctgtattagaattaatcacacacctataaatacaatttatgatatgagaactgcaacaagagaaatggggggagatgagcagtttgctgatcaatagggttaatgatggtaacatagaatcctagtgatatgcctcccattgactaaaatgtatgcgttaagatagcatagcgcataaaatggtgtactgcagtctcagtgtattcaagcttattatggtttctctgcctaggtttgtgtctttggctttagattttctcccataaccccaacctgtccacattcaagtcactactccttgaaatatattattgatctctaaaatctgatgctaagtctgtcttgcccaacggtggccactagccacccatggccattgaatatttgaaacctggctagtccaaactatgctgtgagtataaaaaacccaccagatattaaaaagttagtctgggagaaaaaaacaaatgtagaatgtcttaatgataattatttacattgattgcatgttgaaatgatgaaatttaggatgtactgggttaaaatatattaataaaattaattttacctgtttctttttacctttttatgttaatgtggctacaggaaattttaaattagatatgtggcctctattatatttctgtgagacaaagctgctccaagctgttttggtccagaactatatctcggttcttttgtatcctacatggacctgcatagaatggtatttagtaatactcagcagtagcagagatgatctcttatcaaattatgttaagttttaatttttattcttgtctctcaccctatgtgcacctctctggccaggaggcatttatcatatcaccttttaatatttggaaatcacttgatctgcttgagtcattgtgttgttttcaaatctagaactctttctaccttattttgtaacttctataattaaacaaaaggcgaaccaggagcagcttggctcttagggatgtgtgaaaaggcgctcagtccttaagttggtgccaaaagtgacaaatctataggatgagatgcaggtttatggaagagaagcatgaaaatttttattttttaaaaggacacagcaagctagtcaccaaaagacagatacttgattctacttatatgcggtacctttttgaatttgaagagtcaaattcaaaaagatggaaaacagaatggtggtttccaggttctggaggtgggggaatggggagtggaggtgggggaatggggagtggaggtgggggaatggggagttgtttaatggtgtgcagggttttagtttagcaagatgaaaacagttctggagatggaaggtagtgatggttgtacaacgatatgaatctacttaacactaaactgtataattaaaagtgggtaagcaaagagtgtcttacaaagcaataacttgtaacttaaaatttttaaaaaccttaatgagattagttgtaatgggttatcttaagtagacccttactgccggaaggaacagctgaatcacatcacttgggagcttgttagaaaagcagactcagtcccaccctagacttgtccaatcaaaacctgcattttaacaaggcccccaggtgattcataggcactgtaaagcttgagaagccctgctccaaatatcatttctcaaagtgtgatccatgagccacctgaagcagagccaccctgggaaggtctgttttcaggcgcgtcccagaacacgtaaatcagatctaggctgtggagctagggagaagatgaatctgcagactgatcaggatcccaggtgattttgaagcatggtttgagtttgaaaacccctaatctggaaagctttaacaactattactcttacaattccatcttttaacgaatgttggaattattaaatacttgtaacaagaagtcctgttattgataaaatcaagatatgactaatagtgcagtcaaaaagaggcaacaaaaaagcacctataacttatcttgggttggttaatgaggaagctgtcattcaaaattagtaagactactgtaacatttcttggggtcctgaacattggaatgagagtcggttttcagagttgagcccacctctgtcattagctttgtgcaaacctcatcaggctcaagattcctcatttgtaaaggggaatgaattctctgaccagttagtttacattcctaagacaaggttaaatttggaaagcaaagaattttcggtatatatgtgataattttgaaattcttgaatttttaaaaaatttaaatgccacattacttatatttttttctaaaaaaaagtcaaaccaagcgctgtctagttattaatagataccacagatgagatgcctgagttggtaagctctttttaattctagttcttttcaactacaataattttatagacttttttttgaaggctagaatgttgatgtggaatcaaataggtatgcctctatgtatggtagatgcacctgacagggatcacttgacttgaacatgccctgacaatgatcctgtgtggcaggtgcacctgattctgagttctgagttaagaaatccgggagtgggccgggcggggtggccggtgcctgtaatcccagcactttgggaggccgaggcaggtggatcatttgaggtcggaagtccaagaccagcctggccaatgtggcaaaaccccgtctctactaaaaatacaaaaaccagctgggcgtggtggcgcaggcctgtagtcccagctactttggaggctgaggcaggagaattgcttgaacccgggaggtggaggttgcagtgagccaagatcacgccagtgcactccagcctgggcgacagaatgagactctgtttcaaacaacagcaacaacaaaacccaaaacaaaaaaacaacaacaaagaaatccaggagtggctaacccagagagccattccttatctgtaaggaacatctgagccctcatctccttctgtggaacatgggcctcgccggggattgagaccctttgttatgagttaagtggaagttgccaggtggagattgttagggggagggtgttaaatgagaatgctgtagagaccacatgccttttgcaagcggctgcggttcctctgtccaacccaccaccactggactctctaccctgtatgcaagcccccagtaaaaccctatgagacatacggttcactagctctgggcctcttctggctcttgaacctggtgccatccacattgcagtcagtaggagtttggcatgacaccttattatgtgaacttttatatcaagccattaaatttttttaaaatagactttatattttacaacagttttaaatttacaggaaaattgagaggatagtccagagagttcccataggctttgcatccagttttccctattgttaacatcttatattaatatggtacatttgttgcagtcagtaaaccaattttgatacatggttattaactaaagtctatactttattcagatgtccttagtttttgtctaatgtcctttctgtgttccaggatgccatccaggaaggcgcattatatttaattgtcaggtctccatagcctcctttcctcttggctatgacagtttctttatacttctctagttttttaataaccttaaaggttttgtattggtcagataatttgtaggattcccctctgtgggaattttctcatgctttgcctggggttattggttttaagaaggaagaccacagaggtaaaatgcccatttcatcacatcatatcaagggtacgtgtttatcaacatgatacagccctgttggcattgaccttgatcacctggctcaggtggtggttgttgagtttctccacttgaaaattactcgtcttcccactttatgtgctctactctttggaaggaagtcagtttgcacagcccacaattaaggagcagagaattatgcttcattttcttgagggcagagtatctacataaattatttggaattcttctgcgcaggagatttgtctcttttttcctatttatgtattcattcattcagtcatttagactcatggatatttacattgtactttgatttctaatccagcactacttcataatttttattgctcaaattattccggctttagctattagaagccctttcacttggttcctatgctcatttgacatagcctcttttttttttttcttacaagatgctgcagtctcatcttgcatattttcagccctaatcctagaatcagctgttcctccaaggagcccttgttccttttattggagagtaatgttattggagaatagtattaaaatctggatgttaaggatgctcgttgccactggagtttctttgcttttaagacttctcagttgatagagcaaggcaatgtatttgtccatgttcacccttatgttatgcagatctataaatatttctatagctaactagttgtatttatattaagctataatatctagtctatattaagctaaatacaagttcatccggatgtttcctactctaacgtattaccacatggacactatatctctcctccttggttatgtataaattctcactccatccaccatctatgtacttaattgttcagtttcagtatatgtgcgtagccgtatcagaattgttaacccaggctgggtacagtggctcatgcctgtaatcccaatactttgggaggctgaggcaggtggattgcttgagcccaggaatttgagaccagcctgggcaacatggcataaccccatgtctactaaaaatacaaaaaaattgctggtcatggtagcatgtgcctgtagtcccagctacccgagaagctgaggtgggaggatcacctgagcccaggaagtcaaggctgcagtgagctgtgatcgtgccattgcactccagcctgggagacagagtaagactctttcttaaaaaaataaaaaataaaaaatataaaaaaatttgttaacccacacctatatggatctttttaaaagctgcaagactgctaacaaatatttatttatttatttatttatttatttatttgagacagagtctccctctgtcacccaggctggagtgcaatgacacaatctcagcccactgcaacctctgcttccccggctcaggcgattctcctgccccagcctcccgagtagctaagattacaggcacccgccaccatgcccagctaattttgtatttttagtagagacggggtttcaccatgttagccaggctggtctcgaactcctgacctcaggtgatccacttgcctcggcctcccaaattgctgggattataggtgtgagccaccatgcctggccataaatacttattttgttcccgtggttttttttttcttttctcttttttaaagtaaatcctttgcactatttttattattttaagaccagtgttattcagagcctgggttaaacactattctgtgtgtgtgtgtgtgtgtgtgtgtgtgtttgtttgtttgtttgttttttgagacagagtctcgctctgtcacccatgctggagtgcagtggtgtgatcttggctcactgcaacctccgcctccctggttcgggagattcttcggcctcagcctcccgagtagctgggactataggtgcgcgccaacatgctcagctaatttttgtatttttagtagagacggagtgtcaccatattggccaggctggtttcaaactcctgaccttgtgatccacctcggcctcccaaagtgctgggattacaggcatgagccaccactcccggccagcactattctgtcttatactcactctgccatctgtgtgtgtatatggtacgtatgtgaggctggatctgtgcacttggaaaagttggagagatgatttaggtaaaacttttagttttcacttcttttgcctttttgcttatcttgatccatttagttcctaccatctggcaaatagttctcatctgaagaatcccatctgtcagttctcactattatccggtaatagttacagtgaaatgctggtgacggcaacagccactttttaaaaggatgtgtaattcaccctcatgtcctctttgagaacccagtaactgcccacactctgaagctaaaaccataacagttttatcacatggaaagtttgttgagaaatgtttggctgtttctgtgaagtaatcgtcccgtctcttgagtacagatgcctcccaggaaaattttcccagcctatttgttaatgtgaaagttacaaaagatagcatataatgagcacattcaagacaaaaaaatttgtggagtaagagtctgaaatggtaaaataaaaaatcacttaagaaaacatttatctgtagctgtcattttcatatacacatatctagtgtatacaagttagtaagtacataattctcaaaagttctacctgtctacacatctacacagaaaaattaggaaagtcttgtccagacttttccatcatcttcagtataaagcatcttctagctgttggaatagaaacaagctagattcttgactcctttctatttgattatttagatctgaccttcagacgacatccagaatctgagaacacgcaccacctctactgctctcatcctggtccaagtcattgtcatctcccacctggattaatgccagagcccccttcctggtcttctcacttctagtcttgaccccctagggcaagaataattagcttagaaaaccaccccagagccttccagcattactctgagtactggccagagttggacaatgtttaaggccccgtgcagtcagctgtccctgtcctgtcctggctgtcactcactcgcttgcccactgatctcttccacatcattcctccacgacagcactgatctccttgttcttctgtgagttcaccaggcatgcatctgcctcaagactttgtgtaatacttgttgcttcctctggctagaatattcttccctttgattctgaatactttgttccctcacttcctcaagtcttcactgaaatgtcatattttcaagtaggcattccctgaccaccctatttaaaatttcacccctcagaaaaaacaaacaaaccacccctttctctgctttatctatgtaacatttattaccatccaacagacactgtatttttatctgtattttttatcgcttccccgctaggatcatatatcgttttatctgttttgttcactgctgtattcttagcactgagacataattgtaagtatgcagtgaagagttagtggataaaggacagtggctgcaagaggggatttaggaaacaccccctcccagccaggaccagcactcggtgcaagagttgaaagagttgatcactcagattctctgcttctccagtcgtagggactccaccccgctgtgttgattgctgtcatgtattcaccccatcataagcagtactcacatgtaaaacagtaccatgtcatctctgtggggctacaagtaggtggtgatggtgcaatgaacatataaaaccccagtgtcttcagtaggtgcgaaataggtgattagtgaatgatgaagagtagctgttgctgttttgattactatgattattattatgagaaactactgtggttgatgagatagatactggggagaaggatactattaatataatttattgagcaactttgttctgggcactagttgagtactttagggatattaattcatttaattctcccagttctgccatttactctctatgtgacctggactgttacatagtctctcagtctcaccctctctttttttttttttttttttttttttttttttttgagacggagtctcgctctttcgctcagtctggactgcagtggtgctatcttggctcactgcaacctccacctcccaggttcaagcgattctcctgcctcagcctactgagtagctgggattacaggcatgcaccaccacgcctggctaatttttttgtatttttagtagagacggggtttcaccatattagccagactggtctcgaactcctgaccttgtgatccacccgtctcggcctcccaaagtgctgggattacagacttgagccactgtgcccggcccttgccttctcttataaagtgaaatcattgtagctgctttggtgtggttctgaggacggtgagagaagacgcacgtgaagtattgagggtggtggcaggcacacagttcagagttactaacaatactggtgttttatcttcacaaggcagatctgggcccatagcacaaggaaaccgaggctttggcattttacagtaattacattgccagaacatttcccccactttcttgaatcatctttacctcttgagagatgaggaagagagggcacacctcgggcagaagtccaaagacctcaggcatttttggcctttcattcccatgattctggccaacatcattttagtccccagcagttcatagaaatattgtcttttaatctgatattcaaataatctgtgccttgaagaacctgtgtatggctctagaatcttttacattaatctactcaaccccactctgatgctcaaaacttcagcagtctgttttttttttattttaatgtctttattattatttttttttttgagacggagtctcgctctgtcgcccaggctggagtgcagtggcgcgatctcggctcactgcaagctccgcctcccgggttcacgccattctcctgcctcagcctcccgagtagctgggactacaggcgcccgctaccacgcccggctaattttttgtatttttagtagagacggggtttcaccgtgttagccaggatggtctcgatctcctgaccttgtgatccgcccgcctcggcctcccaaagtgctgggattacaggcgtgagccaccgcgcccggcctaatgtctttattttaaacatttatttttagaggtagggtctctctaagttatgcaggctggcctcaaattcctgggctcaagtgatcctcccaccacagcctcccaagtagctgggatgacacccccaggtgccgccatcctggcagcagagtcagttttgatacatctttcccttctcattcttcccaatgtcatggattgggaagttactgtggttttagttgcagtactttttactctgaattctgtttgcttcctggaattctgtctgtcttttgaaaagacaacataaagaaatcgaaaaatatactttaaattccatagtgtgggagcctctgctactcgcctgtttgatattcattcccattttttcctttctaaaagaattccagattttttttgttcagggtgacaatgtgctctgctgaaaatactttcacagattcccttgcaggtgcatgtgaccagatcacagtaatggcacatatggcctcagtggaatttgctgaggagtatgtccctcccaagtaacagcaaagctttattagaggaaaaaacaacaacagaaaacctttcacctttgtcttgtttctcctgccttctgtctggaacttggacacagagtcttgaatttctgtgaccataaaacacgaggataaaaccaacgtgctcaggatggcagtacagaaagataggaatacgctggtccctgatggcatcatggaatatctgcagtggccctagcttcagtgtcacttcttaggtgagatacataatcctaccgtgtgtttaagccacggtttgacatgtggtctattctctgccgctgactgcattcccagctgttctatatggcttgctagctaatttaagtctagttttattgtcaaattgaccacattgtagattataatattaaagtacttcacagtctaaaagtgaactacttttgtaaaagccaaaggaaatgggccaaatgaaccattttgaacagagtttaaatgagtgagttgagttaccactcttggatggagaactggagacctggattttcagtctagttcttctgccagttggctctgtgggcaagtcacttgacctgagctcttttcctcccatctgcaaaatgaggtaatttgagctagacagtcctcccaaagaccaccaaagagctagcagattgaggcctgcagactcctattgaatttgccatccttgttcaccttgccaagacttcatagccaagaagccagacccagattttgttcattagctttgaaaacaccctttcagttgggtgtgtgtgtgtgtgtgtgtgtgtgtggtgtgtgacatgcgttttgaatataaattgtgaattgttttagcaagaaaccaggttgtatgtttctcaataaacatgcatactgtatattgatgaatttatccacttgaaataaatggtgccaaattgcctaaagtttgctgtaaacaggaacatgatttctcattatgatgtttaatttgttttagtctttgatctcttacatcagaattctgttaagaactctttttacctgaaagatcaaagcaaataagcagaagcatttataaaaataaggtatacgtggctgtggagagaaactccaggtatatacgatcataggctttttaaaattaataaactttgtttttaaaaacaaagcagtggaagttcacagcaagtttgagtagaaagtacagtttccatgtaactgctgtcctagcaaagatttttaagtacaatattttttaattaaaaagagaaaatataaaccgtgctaagccagttggtgaaaaaggcttcattatacttttagcactcttaacgcttattaaaagtttttaaaaacagatttttgtggttgaatcgcttacaatttctgatgtgtaaccttctaacatgtttcatcaaattttaaaagtaatgtaagcagtgctgtccactgctaaattttattttaatgttagaatacaatgaggtttctattttgccattagtcctgagagcttattaagtaaccagttttaatcctttaaaaaaccattctcattttgagggacacatatttcttagctttgtgcaatataagaagctaagaccatcttggcagtatcaaatgaaatgttttgcaagttagaaagttcagtaaccacttataaacataatgaacaattgttatagtcagtctaatgcagaaatacaggtgttgggggcaggggggtggtgggtgggcagacttggtccacaagtagtagtttgccaacctctgtcctaaacacaagttcaagaatatggttctcttggatagattttctgccagatgaaagtaagagtaacatccttagctaatgaactcctaatatccaaggcaacttttaattaattcaggcttttaagaaaagcttgtttaccaactcctcattaaaaatgttcagactggctggtcgtggtggctcatgtctgtaatcccggcactttgggaggctgaggcaggcagattgcttgagcctaggagttcgagaccagcctgggcaacatatctagaccctgtctctgcaaaaagtgaaataattagctgggcatgatggtgcacagctgtagtcccagctactcaggaggctgaggtgggaggattgcatgacccccggaggtcgaagctgcagtgagccattgatccaaccactacattccagccagggtgacagagtgagaccttgtctgaaaacaaacaaacaaaaagattaatgcagtacatgtccttttggtgaataagtaaatatgttttggtaactttagctttgcattataatctagtcgtcagcagattgactaagggcagataaaacaagatgatttggttttgtggtttggcacttactgtctgatttatgcccccaagaactcttgcaggccaaggtcgagtgtatctgatacctgctctggctcttctcacgaactgatttagtagctttgggccagcattagattttttaaactctttgacctatttgtacatgacaggcatttaatctttccagtagttacttgtcaaatagaaaagcatcacttcttagtttggacatttgcaaatatgactgagcagagctgacagatgaggtgggcatcttcaggccatagggtacttctggcctcctgtaacctagaaaattgggatgcctcagatatcaggtattcttccaagcagctagggttagtccctgacctcagaaaccctgagagccctcagaaaccctgagaaatccacctgggaatggtgtatttgttttggatgagattacctttactttccattctccaggtcttcttgtgttttttgtttttgttttgttttgttttgttttatatcattctatgtaaaagagaaatgtggtatcatttgcattatcatgttatttctttccttataatttatatcttaatgcttatctctggggctaggttataatctcctgagttaggtagccttaggtttcttggcggagattcctcccctgggaagtgaggtttataaaagaacccgtgatgtggccctgtggagctgcatggggtgtgtgctcagtactcactggtttcttccctgcaaagtgacacctgcagcctttggggtaccatgtctcataatttttgcattccctgcaacacacactatactgctatgggcatcattgatcattttaaagatttaaggaatgacaagatacagtgcttattctcccctatgatttgcttagatttttatctaaatagtacttattgaaataagtacttcagtatcatgctacatcttacatgtttgagctagaaacagactaaagtttaaacccttttatgagaatgaaaagttacttccttccccttcttagggcttttaatccctctttatgttgcatttcagaaaatgccctatagcgtactatgaaagaaagacattcattcctgtctttgctgctgtgtggacgatctgtattccttgctccgtgggagttgtgggtttatgtctattcttgcatgttttgcctgaaggaccacagtgacctacttggtggtctccctgctttcatggtttcactatgctgatctatccttcacttaattatagagtctatcttaaaaaaaaaaaaaaaaaaaaaaaaacttttggcctatgttgcttcttccaaaatggcatccaaaacctaagcctctttaaaattggagtccagcatgcttccccagtgctacttccttctggactccctttgccacttgctttctgcttccacccatatccagatgggctgcaaatatgccttgctggttctttactctgtctttgcacaggaggctccctcattttgaagggtcttttgctacccatccatccatccatttggattctataatagagttcttgatgtttgacagaactaggccaggaattgtgggggtataatggcaagcaagacagagtctatccttacgttatggaagttcaattcatttcccatgtggcatactacttctcaccattcagattcatctcgaatattgtttcttctttgaggtttttcccactgcacccaagatactggcctgacactttccttatctctattacagaatttaacttgttcattcattaacagatatttattgcctactatgtgcaagaatctgtgctaaaagctgggaatattgcagtaaacaaaaattaagtttacagcttacatataatgtggtaattatccatcttttaccttcattagactgagttcatgtaggactttatgtaatatctttatatcttcaataccagaaatgcctagaaataatttgcataatatacattttctttaaagatttaacaaaagtctgagggacagttttcagaataaactgaattaaactctctctctcttatgtgtgttatgtaaacatatatataaaatacacttttgggttttttgcttaggaagtagaaaaatgctaaaatttctgttacttacaagcagattaaaatgtccaagaaagaaaagtagggatttatattgattctgctcaaatgcttacctagacaatgtcaatatttatattttactcccctgttgtagtagaatggtaattggttctctagttaagcagcttttttaggattaattttgaagcaagaaattcagattaattaagggacaatttcacttgcagcatttaggcattattttaaccatcaaacttgaagtggcaagaaacggagttgcttaaggaggccagacgtaacattctaaaggtagtagggtcttgattgggttgcttaggcattaaaaggctgtttaacttgtcttgaagtctatctttccttgatgtcttctgcggtaagaacactgtgatacagatggaatgacgggaagtggttttcctttctttcagttggtgagtttgtaagtgatgcccttctcgttcctgacaagtgcaaattcttacaccaggagaggatggatgtttgcgaaactcatcttcactggcacaccgtcgccaaagaggtaccagcccataaattctttcttattgcaaagtgaagatttcctggggacgtgcttaatggcattttaggggtattttgaggcaacagctatgttgataagttatttaagaaaaaaacccagtgctactatccgtaacccagattttagtttttagagtgattttaggttcacagcaaaatcgaacagaaaatagagttcccgtgtaccccctgtccccacacatgcgcagcctccccatccatgaatatttttaaaaagtcaaaaatagggccagttgaactagattcattatgtgcctgtgccgtgtttcgcaacttaaaaatataagttgtctgtgccatgccttataacttaaaaatataatctctaatagttataactttaaagtttacccttcagattatttttatgcacctgttgttttcttttgtcatatacaattttttaataatttagccttttcccctgttatctattagtgaatacagtggtagaacagtgaagtagcttttttataccagcctgaaagctccagttagaattcagtttctcagttataccatccagttttatattcagcaggccatgcctaccatcttgatttttccacagggtgagtctgaccgagcacttggttaacctctgcttttggctaagccaataaaagatgtaagatacttagcatgaaaaggtcactgtgtggtaagaccaccttcacagctgctgtgtccctttgatagtttttctaataaatttatatagtttatttgtggcaagatcagtcttaggctaactagaattaggctcctttatctagctcatagtgcttcacttgagtcaattttgatcccctgtccctcaccggaacatgtctggagacattttttgttattacagcttgagggagtggtgttactggcatctgatagtgcccagaggccagagattctgctaaacatcctacagtcaacaggataaccacccgccacccccaagaattaggcagtccaaaacatcaatagtgctggggttgagaaatctgatctagcttagcttaaccattgtatcatagctttatagctgttagacagaaaataccactgaagatttagtattattttatgcctcttataaaatagtatatttggatccactgtagaataaaatgttttttatgtaaaaatgtgttttggaggtttaagagcttgctgagtttaagaaaacaaaccaaataatttgaagtccagctacctatttgataacctcattttttattccttctgtgttttcaaaagaaaaatcctttgtctctaagaaacggaaatgactcccataaggtcaaaatacagtctgtaatattttcattgtctacctttatgtcttgaattattcatccttcatttatcactagtggatgctctcagaactttatgctaatctagatttgtgcaaatttagcaaatcccagaaaagcaaaaagacattcaaggagaaatctctaatgactgtaagttctgattcttagtggctgcaggggataatttcttctcttcccaggattgttactctgaaagtgaaccaagagagtcagaatttctaggataaggcaggtccatgtgagataaacttccatctgtaagggaggtaggagtgagctggggatctacctggaatgcgcacaatttctggatacacgaattaagccagaaggcattaattctctggtatctgttcaccagtggagactgctacatcttatttcccaattagtttccattccagttgttcgtataaacctctattatataacatcgtggtcttattaaataaataataaacaagaataaaaagagtaccaaagtgtaacccatgctaaaaaaaatcctgttgtaaattcactcaaaaagcaaataatcttttcctttgtgaaattggttcctaatatattgggtctgcatgttgattattttatgtggagttttcttacaatgaaacacatctactctaccactcactgttttctccttacactttgtagacatgcagtgagaagagtaccaacttgcatgactacggcatgttgctgccctgcggaattgacaagttccgaggggtagagtttgtgtgttgcccactggctgaagaaagtgacaatgtggattctgctgatgcggaggaggatgactcggatgtctggtggggcggagcagacacagactatgcagatgggaggtaaggtggcctttgtgttcagcctcagagatgctgaaacatcttgtatggagtatttgtatcctgtaaattaatctttctgtttatcactgaaaaggtctctgcccactcccatcagagtctgctgttatgcaaaaatctgaactatgaatttttatggcatcctgttgaattaataatatcagtcacccatcacagagttaattttaactatttaatattaaacttgggatcaaaatcccactgataactatcataggttactggtagttctaacagggagttgaaataataatggcgttctgttttggtcattaatttaaaaatatttttaaatgctctctgggattgtcagtcattagtttaaggtgaattttcgttaaaggtttggtttgagattttgggcgttctctgtgtggatgtgtaagggtttttttttggccttttatcatttcttttccttcatagtggaagtcaaaggcattaataaatgcttgttaattttttttaactacctttgatttgttgattgtaaagaaacctattttcgcctctttttcttagggagcttagtcccgttacttcttacctgattctcattcttaactgaaggcaaacatctatattcaaatcataaaattataaaatgagaatctttgggttggaaatgccatctggttcaggcattgattttatgctgtctcatcccccgaagggtgatgattgtatcacttatcttattccttcagtattctcttagatgttccctagagctacagatttccaaacagcacattcaataggagttgtaagtttataatcggcaaactacaggatgcttgtttttttttcttttaatttctggtgtaatctgctactagggcccccatagagtttattgtctatatcagctagaacactgggaccacagtcataaactgaaggatccaggcaaactgggtcatatggttacccccaccaattacagtcttcagtgatgatgtcactatccaggttgatattcagttgaaatgctagccagctccttcctagttaccttcatttacatcccatttcagtacctgaacacagtcatgctttagactctgaaattccttagaaatagtaccataaggtttatagctttgatattcctctctgatcatgatcttccctcataatcacctccccagttcaggcttttagtccattatcctctttttccctgcctgcctttctaatcaggatggaatcaatggataaccattcttacctattccattgaacatccttgacttggctgaaacccttcacattttctaaacatatttttgtcaattctccatagctaggaaaaattaatttctttctttagttgcttctgggatttctaaagtatcaagtcatgtaaccttaccacttaattccatttcttattcatgctgtaacatcagctgggatcttaatgttactagatgcacctaattatctctgtcttgatgacctatcatcttccccatagcagttgatccagcccaacttcattctccttggttcccagcgtaactctctctcatgctctacagatgacccctccaccgtcatccattgtgaatttctgcaacatggtacctgacatttggtaggtgcccagtacgtgtttgttgaataaaccattgaattttctcctgtacttcagcaactcttgtaccttcttctatccctttgtttcctgtcttcccttttatgattatgttctgctggactctcaatcatctcctctccctttcttgcattttcagtctccctctcccccacacccccaggcttcatccaccctcctcccagataattctttcccatgtgttactatctttctactatgtgtttttaatcctgttgacagttggtaggaaatatttgatggtttattctacctgtagaaaagtccaaattctcttgcagggcattcagaagtctcttacatggcttcagcctgcattttcagccttatacatgtatgtgactctcctggcatcctaaaaccattgaccttttctttctctaggctttcattcccaccgttctgccccatctgaaatatttttcctttttttgtcaaatggggttaatgtatgataaagatatttgtcaactctaaagtgccacttcttatgacccgtcaaaatctatatatttataaatgttcacctgaaaagatgcagcctttacaagtctttacaggtgccttgctctgctatactacccttgctttacctttttcttataagaccataacttatcttccaattaattgtagtcatatctctttttatctgttagaatccaaactatagtttatgtgtctggtatgtcttgcacataggtcctcaataaatattagacaaagtaaattgtatattttaaattttttttcatagcttttggtaaggacttcatggtccacgattggatattgtagaaagcttatccagcccactgcccaggacgactttgaatgcggaccaacacaaattcataaactttcttaaaacattatgaaatttttttgcctttttttttctataggccctgttatagagcctcccatcttttagcaaagaactgtctaatacaaatgtaatgtgagccacatactttttcgttttctttttttaagatggagtctcgctctgtcacccaggctggagtgcagtggcgtgatctcggctcactgcaacctccacctcccgggttcaagcgattctcctgcctcagcctcctaagtagctgggattacagacatgtgccagcatgcccagctaatttttttttttttgtacttttagtagaggtggggtttcaccatgttggccgggctgatctcgaactcctgacctcgtcatccaccaacctcagcctcccaaagtgctgggattacaggcttgagccaccgtgcctggccttactttttcattttctaatagacagtttaaaaatagtaaaaagaaacaggtgaatttaattttaacaacattttatttaatccagtatatctgaaatatcatgtgaccaatatgaaaaatttaataagatagttcacattctttttttatgtttctttctttcgtaagaagtcttaacacttcttttaacatttaacagcacgtctcaattcatactagccacacactgtgtttgatagttacatgtggctggtgactactatatttggacagtgtagttcctggatgacttgaaatttcttatcactctttatttttccattaagacagacggtttgtataacctagtaatgttttctaaggctgagccactgaatttttattattgtttttaactattcttgtttttaaaatttaaaaaaattggtttggattcagtataattagtatatcaggtcacttgcaccattttattttttaacttcttttcctgtagccctgcaggcgggcagggcttctttcatgtggacaaaaccagaaaggtgttgcatcactgatccacacacaaggtgggctcctgccaactggcagcctccttgttccaggaaccagccctccttttgacacttgaaatgtaaaatcagaatagaagtttaacgtacctgacttaaaacatcttcaggggatgctacgtgacaattcttgaagaaggagaaacgagctaccattttcctggaaacaatatttgattcacagtattttgttgtttggtagttaatgaggcttgttttgatagaagatgagtgtttttctatcgctaatggggcatttagagaaacattccttgtaggatgagctctgttttatgacctcattgaaaaagaggtatgaaaaagaggtaaatctttaacataggcaaaacaggtagtgtttcagaaatttatgtgtaaattaccgagtatatttttctccagtgttgtaatggtcatattctcagatcacctcaaaatacctatttatgcagtctgtaatgtagcataatccagactgttactaacattatgtagcataatgttaataataataattacgtacataatgttaataatacacagactccagccatcgtgggtaagatttttttccatgggaaaattcatttggaaagctaacttgtaagactagccaggtaggcagcctagccctggaggcagagctgctcctcacctggaactgcagaatctgattgaacccagtggtccatgggggttgctgaattcgtaaagcaaatgaaatgttagaagaccctctaattgttgtagagtcacacttttcctcttgcagaggaggtactcacattttttttaagaaacaatctttaattatcgatgtattcttttaggtttaggtttgcagacactggtgagcgtgtgctgagaggtaacttgatgtatctttctggataattagatgattttttttttctatttctttgaacattttttttttaaagagctgcttaagatctggaggagtgattccttttgaccgtgtcttattttcattaagactgtataacttggaagagtttttttttttctttttctttttcttttttttttaagatgaagtttttgctcttgttgcccaggctggagtacagtggtgtgatcttggctcactgcaacctctgcctcctgggttcaaacgattctcctgactcagcttcccgagtaattgggattacaggtgttcaccaccacacccagctaatttttgtatttttagtagagacagggtttcaccatgttggccaggttagttaatgttactctctggtttggggggcagtgatatgttttggcttttttcccacccagatctcttcttgaattcccatgtgttgtggaagggactcggtgggaggcaattgaatcatgggggcaagtctttcccatgctgttcctgtgaagtgaataagtctcacgagatctgatggttttaaaaagaggggttcccctgcacaagttctctctctttgcctgctgccatacatgtaagacatgacttgctcctccttgccttccaccgtgattgtgaggcttccccagccatgtggaactgtaagtccagttaaacctctttcttctgtaaattacccagtctcaggtatgcctttatcggcaacatgcaaatgaactaatacagctcggggtggcttgtgtgggtgcgtatggccatgtatgcaggtgtgcgtgcattggaatatacaattccgtattgaacccagtttaaacttcatcagttctggtgattgctggagtgtcacatatggcaagacgtcaccttgccctctaactacaccagaaaaccaggccagcaccattgactatctagatacagtgggccgtttatattattattgtttcatatttttagattatttggtaaacaatttacagaactaagaataaaggaatagtgagaaataactattagcaattttaataagagttaacatagtaaatattttaattttacgaagaatttaaatatggtaaacccacatgtttattctgtattttcccagttttgaaggtatggatttctgaaatgagcattatcctttggaatgcagctagctgctaatcacctgccatgcacgaacctgaaatatatccgtcttacaaatactggttctacatttcaaatacatctctattaggttcatcatatttcttggtcttttttttttatacttgcaatttcatttaattattgtaaaaatttaagatatttaaaacattgacagctcataattttattgaagagagaatatagccatcttccctcaggaataaaatgttttcaagtttggatttgtaaacagctattaaaatgatcaagccagtctttttttccccctttttttctgcattatctcttctaatcaccttagagagattcctgccttgggcatttgtccacttcctaatggtatcaaataaatgtgttgcacagacataaaatgtgttgcataagcatcataaaatggcaaggaatactgtcacatcattttagcaatgatggttaatgtttttgtcacataatattgagtgatgatatccttcctgttgaatgactaagtggatgagaataccatatttcctttttattcttagaaatacattgctcagccgggcgcagtagctcacgcctgtaatcccagcactttgggaggccgaggtgggccgatcgcctgaggttgggagttcgagaccagcctgaccaacatggagaaagcccatccctactaaaaatacaaaattagctaggcgtggtggcgcatgcctgtaatcccagctactcgggaggctgaggcaggagaatcaattgaaccagggaggcagaggttgcagtgagccaagattgcaccatcacactccagcctgggcaataagagcgaaactccacctcaaaaaagaaagaaagaaagaaagaaatacattgctcacttgtcaattcttgagcttgagaaaattcatctaggatatcatgtgaaggctcatagcctaaggttttacttacgtgatcaatttcattcttcttctggtttatctaattggtaaaatgcctccttctgtcagttgttcctatttgccaatatgtggaagatgatttttgactatattcagtgagtctccagacttctttttatcatgctttttaaagagatgggacctcactctgttgcccagacttgagcgcagtggctattcactggtgtgagtatggtgcattacagctgcaaactcctgggctcaagtgatcctcatgcctcaacatcccaagtagctgggactatgcagactttttttaaaccatcttgaaagatgatgcagtactttgggaacacagcaataaaaatgtgataatttccctattgcatcacctttctaggcaattatatcattctttcatgctcatattattttgtcttctttagcacagtttttaaatagttgatggctaatgatgaaataattcttcggatgataaatattttgtaacataggaacacaatataggaaaaagatcgaggttcataccatatctcagactcatggttaagtacaagctagaatgagttttagtcgattaaatttctttttctctatgaatggataaagtgagaatatcagcccacaagtagttagaagtgctcagaactcaaaggtaaaattgtgtccaagacctgatggtattctaaaggttaacagcctatcctacttaccaagaatttacatttattatgaggcctgtacaacctgatgcaggaaaatacttggcataattttctataagttaggtagttaggtgctcaacaagtatttgagttgaatcacattggcattcacatcaaacacatacacctacgtcatcatgttaacttaaggttaatagtgtcaccaaaactaactggtctttaaaaaagaaaaactaggccaggcatggtggctcatgcctgtaatcccagcactttgggaggccgaggctggcagatctcttgatgtcaggagttcaagaccagcctggccaacatggaaaaaccccctctctactaaaaatacaaaatagccaggcatggtggcatgtgcctgtaatcccagctactggggagactgccagagaatcgcttgaacccaggaggtggaggttgcagtgagctgagatcgcaccactgcacttcagcctgggcaacagagcaagactctgtctcaaaaaaaaaagaaaagaaaagaaaagaaaaactaaggaatatcattctagacatgcagtaattaagtaaaattgcatcaggagtctaataacatagcatgatgggtcccatgtttcattatttccatgggcagaagagggatggctacattataaataaaggaaaattgtaagaataagaaaagatgaagtatgaaatatttccaactcaaaaacaaactgtatctgagcatgcagaggtacaaaatgtcacctttttcctccagtgtaatgaagggcactaaacctcttgagcatttgatatgttccagatactatattaaagtgatttttttttttaggagacaggttcttgctgtcacacatgctggagtgcagtattgcaaccatagatcagtgtaaccttgaactcctgggctcaagtgatcctcctgcctcagcctcccaaatggctaagactacaaacacattgccaccatgcctgcctaatttattttgatttatttattttttttgtagagacaggggtctcactatgttgcccagactgttttcaaactcctggcctcaagtgatcctcctgcctgggcctcccaaagtgttgagattacaggcatgagccaccacgccagaccaaggggtgaaatcttgataacaataatcaatgcagtcatcataaaacgcttgcacaggctcaatttgtaggtggcacagtgctacatctagtcaaaagcaaatttaattatggtcattgtgctctgagaacttttctcagaaaataataaccagatggtattatagatggtgcatttcacaaatacatgatttgtagttagtgaaaacttgtcattcaatcatgtaataaattatgcacatgccggtcttccacttagctagtgatgttgaaacattcatagccttacctgatgagctcaggctgtcatgagaatttatgtctattcagtactttgtctttaaaattaggtgagagagaaagagaggctgtatttgactatatatctttttatttgtatctctggagttacaagtttttgaatatataatctttcagctgcctttctgcattgcattttgagaaatgatattaaatgctcaaggaaaaaaaacctaacaactttagagggccgcaaagtgaatcatacaaaagataaattaaagctttaaatctttgccagtggatgagtcaagtaagagtggatttaatgaaatggctcatggctttgagaagcagctgtcataatgctgggttggcagcttccaggactgtgtgaggctttctgactgtctatactgaaataggagaactcatttgaaaatgacgaataggagaatagcagaaacttgcattttcttttgagggaactggctgccagttttgaggtccttatttagaaatgctcgattcctgtattgaataaacttggactacatgtatgtcaaaaagaaaagcaaaacacttttatagccttaagcagattacagatgtgtggccaaaccagtggggtctgtttttgtttccaagcaggtgatggctggaagaggagatgcctctgtagtgcagggcttgagttgctgctgtctgagctacatctggcaatgagactgtgctgcttactgagacctaatggcacaggttgccccagtaacaggatattgctgaatgagaaatactgtaggattcatttgtaagagttatttggagggttggattattcagtgctaaggatcctaagctactgatgcatggactcttttcttccctccagtatcttttaattaaactgtacaaattccctggcttaaaaatagtaggaaaagaggaagaaaatacagattcttatgattttaactggtctctggcaatagtacaccgaaacattaatttcttgttgaaaccatctggatatttgtatcttcagtgtaaaacccctaatttagataggactctccattgtgacatggaaaaataaccctttaattagttaattaattttactgtggcctcaaaatctacatattagcatatcaagccaaaaactgttggctttacttgggagccatgtggcttaaactagtaccagtaacttaccacaaggaactcagcaaaattataagtccatgtttgttttggaaggaaggcaattattacgaaaataatttagagatgttcaaactatttcctttgagtagaggtagagagtgaacaaaatctgtcccaagtgggagctaactagcttccttttttgccctccctgtttacaaagtaacacttttagtttactaggtaacatttgcagtatccccagtgtttcaatgtaaaattgtaggtggtagactaatgccacttagccaaagccatgatcacctgaatttttaatatatatttttgtatggagtgagatactgggagaacagtcttcattagcttaaactctagaatgtactgtttgtttgtttgtttgtttgtttgttttgagatagagtctcgctctgtcacccaggctgcagtgcaatggtgcaatctcagctcactgcaacctcccctcccaagttcaagtggtactcctgcctcagtctcccgaggattacaggtgcctgcttccacactcagctttttttttttttttttaatggagacggagtctcactctgttgcccaggctggagtgcagtggtgtgatttgggctcactgcaacctctgcctcccaggttcaagcgattctcctgccttagcctcccgagtcgctgggattacaggtgccaaccaccatgcctggctaatttttgtatttttagtagagacgaggtttcaccatgttggtcaggctggtctcgaattcctgacctcaagtgatccactggcctcggcctcccaaagtgctgggattacaggcataagctaccatgcccagccaagaatgtacaatatttttaaagaaatgcggtttattaccataaaatacaggttgagcatccctaatccaaaatctgaaatgccctaaaatccaaaatgttttgagcactgacatgacagcaaacgtagaaaattatgtgactttatgtgttcaatgtatacaaacttcctttctgaaacaaaaattatttaaaatgttgtataaaattgccttcaggctgtgtgtataaggtatttttgaaacataaatgaattttatgtttatacttgggtcccatctccaacatatcttatatgtatggaaatatcccaaaatttgaaaaaaatctgaaatctgaaacacttctggtcccaggcagtttggataaggattactcaatctgtaaatacagtagctcaaattgattttgtaaggcagtcaagttattatttatagtattttaatttgtattattcttttaatatagcaattcattttatatatttatataaataaattttttgcaattgagcaaattaaaaaaattaagtgcttccttcagatctacattttattttctatttgttatcaatttaataagtaaaggacacacagatcatctgattgtgttgtcagacatttgaaggtgcaactgatgaatgttcactgttgtactttgttttgtcatgtaaattgttttaaagagaagtgaatgttgagcatatagtaggccacacgtgcctgtggattggctcattgttttaggaatgtgtaattctggaaaagatttgccaagggtattcaaaagtatagtttgatattagaaattatttgaaaataatctttatagcatagcaccattttatttagatcaatagtaattcaagcagtatacataatttgctattgtaagcgtagcatataacctaagttttcttttacatttgagaccactgtttgctgttggtcgaatttggtcttccaagattttttgcttagtgacctaattgccagcctttgtgaagagctgttacttattgtcaaaccaggcagtaagggtttgcttttatctttttatcagttctttcaatgctagtagtcatgagattaatgtagttggatactaaaatgttaatacgtgttagataacaaactgggaaagagatgaatgacatcatgaaggaaagggcagtattgcacttacagtgatttcatgatgatagaactaacctgcctaaaaagacattgggtggaaacagaaaccaggtgtaatagacgcatccaagtagtcaaggaaagaaaagacttgtaagtaaataagataatctttgcttcaaaaatatcttcaaaggtttaaaatgtgctttaccctcatatataatctttttgagcctatttctttacctcaaacatggggaaaattgcaataatctgtatcacggtatttgcttccaaaacgactaattggtgtaaatgcatatcaagccggtaaagtttacagtggacttgtttaaaatgcgtagattggaattgttgggggagcaggccagcagcatgggatgttttttttgtttgtttgtttgtttaagactctgtcgcccagactggagtgcagtggcacaatctcggctcactgcaacctccgtctcctgagttcaagcaattctcctacctcagcctcccaagtagctgggattacgggtgcctgccaccacgcccagctagtttttacatttttagtagagacagggtatcaccacgttggccagactggtctcgaactcctgacctcaggtgatccgcctgcctcgggctcccaaagtgctgggattacaggcgtgagacaccgcgccagctggggtgatttttttcttagtcaaatcacttctctacccatcatctcacactgtcgaatacaaagactctccttggggctcaatgactcatctcccacctctggtttgataatcatggctattataacatgttccctttttaattagttattttaaaattattgtaggtcttgtaatcataatcaataataatacgtaatggctccttaagcacttctatcctagataaggttgagaacattattaaaattagttttggtagtaatcaagtaatgataattcttatttatgaatttaaatatgtaggagtttttttattttagggaagcaaaaaggactagaaagtatgatgtctcatgattagaaaactgctataaaaatgaaggtagaattgatttgggctgttttggacattttaaatagaaatttaaataggtattcaaatagcaaagtcattctactttaaaacttctatacttttttaggatcttcaattttatatttaaattatatttttgaaatggttttagaagaaatattgtatcttaaactctaactactaataagtaagagaagatatatcaaaggtttgatcttttatctcctagaatatactattcattcgtttcccattgtacgtcatttgaatgttaatggttagcctcaaatggttttcaacataattgtatagctactattattggaaaattggagccaaggactcatacacatatcagaagtggtaatgaagcactttggttttatgaaaatatgtttacaaggtagtcacaggatagcaatattgcatttactgtaatacaatgatggtggaactaagtgcagtggaacaggatgctgagaccacagttaccgcatctctaagtgcctcgtctagttatggtccaacctcagatataactcattggtgttgaaacacacctagcaacattttaagcatagaccgttcattaaaaggtacctttttaaaaatttttatttttaaaaattgacatgtaataattgtacacatttacagggtacacagtgatcagatcagactgatcagcatattcatctcaggcatgtatcatttctttgtgttgggaaaattcaatatcctgcttctagctgtttgagattatgtcatatattactgttaactgtagtcatcctacagtgctgtagagcactagaacttattcctcttatctagctgtaatttggtatcctttaacaaatctttctctatcctcagtttctacctacccttcccagcctccatcatcctctgttctactctttacgtctatgaaatcaacattttctagcttctgcatatgagagcatgtggtgtttaactttctgtttttggcttatttcacttaacatatgtcctccagttccatccatgttgcttcaaatgacaggattttattcttttgtatggcttaatagtatttcattatacgtgcatgcacgcacggacacacacacatacacacacacacacacatcacattttcttcatccattagtctctttggacatctaggttattccatatcttggctattgtgagtagtgctgcagtaaatatgggagtgcagatacctcttttaatatactgatttctcttcctttagataaatgcccagtagtgggattgctggatcgtatggtagctctatttttagttttttgaggaatctccatactatcctcaaatggttgtactagaacagagcttttttaccttccttccatttgggaatcttcttacccaacatgtatattagtaacttggctatgtatgttccattctctgtctcaaatactgtgtctaggacatctgcaatctttggctatgaccacgactgtaaagtgcatgacgcttttgctctgtcatcagtattagttgacaggcaagtaagatagtacttctcttcataacccctttacctgcccagcagaataccagtacagacagacccagaatatctctgggctcaagaatccagacatttataggatgggacttttatctataaatcaccttaagattagtaagttcttagaattggttacctttgccatttctcagaagccctttgtctagtaacctgtgtgtcactgtcatttccagcctgtctttcctacacattgtttatgcaggctttaggagtgcccaccccccagttctaccccccacccccaccctagcctttgtggttttaattatcctgtcttggctgattttgttttgttttgacatttcatccattaaattcctgacactggctatctctttacaattattatactatttttctttctggctcgctcttcctgattgctgtaatccatgcccttgactttaaataccatttgtaagtagactaggccaaggtttatttctctaggccagactctacctagttatttcataggcatatgaatcctaacatgtccaaatgagagttcttaattcccctgctacccagtcctcaatgtggttctctcaaagctattctatctcagtaatggtcctatgccctctcctagggattattgctgagaacctagaactcatcatcgtctcttctgcacatcctatgaattctggatttatccacttatctccatcttttccagcactaatctaaactcccattgtttcttgctggagttatttccgtatcctgctaatctctgctctcgttctctctccctgacacatgcgctgctttcttctcccacaccaagccattctctgtacagcagccaggatgtagagtgtttatttacataaagcagatcctggaacccccaaatttaagttgtgttcgtggcttaccaatacgcttaaaaaccaagtgcacagagagaaaacaatgaagccttatttggatatgctgaggataattgataacgggtaacaactaacaaacacgtagttggtgtcaggtttgacctcctacattccttacaggtattagtgtatttgacccagctcctccctacctccgcaatatcaccccatgcctctctttcccccgactctcccctgctcagtgtcacacaagtcaatatccccagcttgctaacccccgggctgacagatctcattgtctataatggatgttccaaggtcccaccttcagcctcagttttgttgccatctttccagaatgaattcccttgatcattctgttttttggagacaaggtcctgctctgtcacctaggctggagtgcagtggcatgatcatggctcactgtagccttgacctccctggctctggagatcctcctgagtagctgggactacaggctgcacctggctaatttttttttaatttttagtggagacaagatctcactttgttgcccaggcttgtctcaaactcctgaactcaagcagtcctcccacctccgtctcccagagtgctagaattacaggcatgagccaccatgcctggccctgatcattcttttctgaagaaaacaccccttcttcattattctcaatcctagcagcctatttacttccattctgaaatgaatcacattttagtattttattggttcgttgtcgttctctccccccatagaatgtaatctctctgagtacagggagcttatctttttcccttttggagcctcggatccagcagaatgccagacacttagcagccactagcatttgatgagtgaatggcttttcatacacaattttagacattgttcctgattggtctctctagtcaataatagatttatcaaatctaatcgataatagatttctttttcttttctttttttctttttctttttctttttttttttgagaagtcttgctctgtcgcccaggctggagtgcagtggcatgatcttggctcactgcaggctctgcctcccaggttcacgccattctcctgcctcagcctcccaagtaactgggactataggcgcccgccaccatgcccagctattttttgtgttttagtagagatggggtttcactgtgttagccaggatggtctcgatctcctgtcctcaagatccgcccgcctcagcctcccagagtgctgggattacaggcctgagccaccgtgcctggccgatagtagatttcttttattgattagagagactaatcagcaacaatgttttaaaattctcacatagatctctgaatgggaaagcagtcttgaattatgcttgcagggagagagaggggaaggaaggaggaggaatggtataattagacttcataaggctagattttgtttctacttaaataatggtatcacagtgggacatattatccatgcagaaagtgagtgggcatctggtctattatctgtggtctttcaggaatggcagctctttagtttaaaaaacaacaaagtgcagcactgtttatttaatggaaatagaaaagcagtgcctgtgtattagtggctcagatttttttgttctttgttttcagctgtctgctgtatgcctctccagcggggtcttacagaatctcaagtctaccatgatcaaagctgaacccattagctccatttcttaattcctcctgtatcctctgttaccattagtaactattctccaactcaaagcatcagattcctcctcttactcactcccttcatccccagtcaccagttctgtgctgttattttatccaagttctcagtaggcttcacgagcaccgccttcacatcccaactgtcgctcctccacctatctgtcctccatgcttctgctagctcatgtttgttgcaatacaactaaccttgccactcttctgcttcaggcttttctactaggctctgcatctagatgatggtccagactcctcagcctgtgaaacaaagcccttcataaaagagcagagctacagctagtcagctcccttcctgcagtccaccccctcctccaccatactgagaattggcaattcctgtagcactctttgtatgagtccattttcacactgctataaagatataaccaagactgggtagtttataaaggaaagaggtttaattgactcacagttctgcatggctgaggaggcctcaggaaacttacaatcatggcagaaggggaagcaaacacatccttcttcataaggcggcaggaaagagaagagcgaggagcagagtgggaacagccccttataaaactgtcagatctcctgagaactccctcactgtcacgagaacagcatggggaaaccactcccatgatccaattccgtcccaccaggtctttctctagacacatggggattatgaggattacaattcaagatgagatttgagtgaggacacagccaaaccatatcactcttcatctgctacgggtgccattccctgtttctacagtgtcctgtttgctaccttctttgtagatttctattcattcatcatgtcccagtttacctgttacctcttcaacagattattcttcagtctgtccctcccaaactccaccaatgaacattctttgttcagcccattattgttaatatgcacttcactgaaaacactgttttatgcttgtttacatcccatctctgcagggctctgagcctatagtcagcagttgggaacttactaggcatagcgcccagtaaaggatagctctttatatatatatatatattttttttttttctaaaataataagccccaagaaaaacattacctgtgaaaaacaaatgatatttttataccattttcaaaacctaatagcaataaaaagaaaagaaatgtcataagtatacatttaagctgtagttaaaaacagtaaataggcacagtatttaactcttatcatgtgctgttccaagtgtgttatttacatcattggctgttcacaccatcccctgaggtggttaatatttccatcccatgttaaagatgaggaaaccaagtcacagcagcctaagtgacatgttcatagtcacattggagctggcaggtggcagcactgagaatgaaacccacgtggctgagctctggaaagtcaccattaatcaccacactagaccttctctctaggatctacataactagaacatacaattaactggagtatatgtaagtgtagtcgttccttgagaaaggaaaagaattcacaaatttcatagcctcatcccttgtgcatttgtggcattgtgctaggggtgtctatttgatatttgaccctacagatttctcagatgccaaccaaccacagatactttaaaaaaagatacttaatacttaccaatgcaagaaagtgggcttgttggaagaggaaaaatgttagctcactaatggaaaatcaactaaaagtcttacctctccagaacatgcttttcctaaatgttgtggctaacccaagaagctacatcatctttacctttatgatacaatttaaagtacttttctacttacttcaagccctcagagcacagaggcaagggaggccttgggctataaaccctgtagcctgagccacatggcttcttctcctggacagatacctggcatattctgccactgaggatcagtggtgcagatgtatctgttttctcctaggaatggggctccacttacgaatctggggcaggacaaggtattgctgcattttggggagcgtgctggaaggaggagcagagtttgttgtttttgcttcctgatatggactggctgtgtctccattcaaatatcaacttcaattatatctcccagaattcccacatgttgtggagggacccaggggaggtaattgattcatgggggctgatcttctctgtactattcttgcgataatgaataagtctcacaagatctcatgggtttatcaggggtttctgcttttgcttcttcctcatttttctcttgccttttcctcatttttctcttgccgccaccatgtaagaaatgcctttcacctcccgccatgattctgaggcctccccagccatgtggaactgtaagtcccattaaacctctttttctccccaatcttgggtatgtctttatcagcagcatgaaaacagactgatacacttccttaacagaaccaattattttttcccaaaaaagagggggagaagcccagaagcatgcagcttctctcttctttctaaggaataggtcttcacaaagtgcccccaaaagaaaaggaccaggcttttctcttactttgtgactttcctaggttgctttgtagccattttggacacagaccacctatagctgtgtagtagttctcatgtgtatggacacagtggaaggagatgccaggcacatagttcttgctgcattgacaccttttcagggcatcttcttttaccatcttctgtagaaactgcaacagcccggccaactaccagccccagcccacccctagctttgctgctttcattttctctgtaacacttgtcaccttgtaatgtgctagtgtaacatcgttgttttagttttcttatatctttccttccctgtagaatgtaaataccaggaaggcagggaattttgtctgctttattctctgcagcatccctagactccagagcagaccctggaactcaaatatttgttagacagccaaaggtcatatacttccaactctccacccaaaatatatatggatcacccatccttagtagcagctaaacctttggacatgaggaatttgctcgttcacagttttctggcctagcatctgattaaccaaactttttcacatatcaagaatttaaaatgactccaaaactttttatgaccttaggtgcttctccttaattctagttggttcataaagctgtcagaacaataatctgcttttgataatatatgacttttcttgcctccaagatagcctttaaaaaagcaatttagccttttactgtaattatattccaaatttaagtcttgccagaatatcattttccccctttaaacatactttttatgatgccaagatattttaaagaaaagttcagataggaagcatatttaagatgtcagtatatgtctctaaaatctaagaacatttttctacagagtccagatgataccatctcacccacaaaattaacataaatttttagtaccattggataccatgtccatattcagattctccctgagttccagaaaggtccttcacaggttatgcatttcacatcctatccggcaccagggccagcatcttacatccttaattcttaggattcagaatagcactttttatatcctgacactgacttgctgaagaagctgtaccagttttcctataaactgtccactccttggatttgtcttatatcatgtcccaggggtattgtttagattgttgctctattgctaggatattcatgttaccctaagtgtgtactgagatagcagagtaaagagagattgtcttttaaaggttctgcccaggaactgctggtttacacaaaagctgggctttagtgcttctcggatctctttgcttgtttcagtaatttttttttagaaattcactaattcactaacgtaagtggggcagggtttacaggagcatgtgttgagagaagttggtttgactttaaatggtcatttttacaatccgtatttaggccttacaggtcgcatacaatctctgtcacatattgctgtcatttttaccccctttcttttctttttataatcctttaaaaaatgcaaagcccacccttagctcacaggatgtacaagaacaagttgcgggttgcagtttgccaagacctgctctgtgccactgctgacttgccattcttggagcccactttctgttcttgtcagccaattccctttcaggtgctcaggtttccctccctcctgtcaccgggcctttgcacatgctctacccaccctgcctagtggagagctatctttggcccctggacttcattcacttcggaccttctttgggtcacatttcagtcatgcctcactagacacctggaatctctgcctcactagacacactagcactcactcttttgggtcttctggctgtatgtaattgttatcagggcagtaattttgcatttatacaggtgctgaggtcagtgtctggcctttggctacttgccttgtgagccacctttgctttccagtgtacccctagctcctggcccagtgtccagcttcccagcatccattcatgttttccctggagaccattctgtgcccagcagccagagacatcattgcaacttaaatctcattgagtcgttccagttgctgtaagaaatgtaaccgtactgggtaacactatgcctgtctgtctccaccaccagatcttatacttcctccctcatctgctactccctaagctcactggccctttgttgtttttgctgaacgtgctaatctcttcctcacacctgggcctttgcacttgctcttacccctgcctcagccatccatgcactctcttggttttgccgtgcccgacttcagcatttttagttcacatggctcttccgtggggcccttccctgaccaccctgtttgaaatgctacccatccctggcacacatctatcatagtcattcattagcaattagccccatctcctttccctatagtacttttccataattttttttcttgctcatattacacctccccaactaatagatagattccaagaaattgagtgctttatcttcactacctggaatagtactggcacttggtaaagcacagcgaatattgttgattgaattactaggggttggcttagagaggtacttaatggaatgattcaatggatgaatgaatgaatgcattgccacttttttgctcattatcatcaatttgtacatatgcctttcaactcaaatatttatccattggctaaagaaaaaaaatacctgaatccccgtgtctctgcagtttacccttcctcactgttaaaactcagtgcctgtgtaaaatttcattatattttatttacttcttattccacttgtgcattatgtggatattcctgcctcatccccacagccacctatcacttccggccaactcagatgcctctggtcgcaacaatcacttctctgttgaatttctgaagcgtttaatctgcagtatgtctgttactcatacagcagttagtgtgaattgtctcactcagaataagtattcattaaatgtgtaagaatgatgatatagcctaatttcagatcaagattgtgatttatagctcattcttaatcagctgtgtcatgactttatttatttattccttttttttttttttttgagacagagtctcactctgtcacccaggctggagtgcaatgcagcttctgcctcctgagttcaagtgattctcatgcctcagcctcccaagtagctgggattacaggcgtgcacccccacgtccagctaattttttgtatttttagtagagacggaatttcactatgttggccaggctggtctcgaactcctggccccaagtgatctgcctgcctcggccccgcaacgtgctgggattacaggcatgagccacctcctcaggcctgagtcatgaatttttggtagtccagtcatgtggttatcttcctaaagctggaggccttaaacctagggccccaggtgggcttatgcctttagctgcaagtaacaagaaacccttttcaacctttttactgatttatttagagagaagtacacataagaggtaatgcaagtaagcaaagttttttaagaccacacaactagatagccagcatccggaccagaacacagagacttgctggcccctagaatcctctctcctggcccctgccagttactggcctttcccctgagttctatttgcctgcagtttgcttgttttcatatttaattcaaatagaattaggtgatgtgtccccttgtgtttcgcttctaacagtgcctttatgcgggagaagtactggctatttcttactttgccctccctccccggaaacattttcctaatttagtagcagtaatttcaaaaactgctttcctttcggacaaactgacttatccagccattgtaccttccagtttagactctggcagtttggagagttgagacagagagaaggagaaccgtctgtttatcttcttgaaaaaaactactgtattttctctctcttctgactctgggagcctctagactcttttttcccattttcatatccacagaggaagagtctgaacctcttcctgctgagctttcccctggttggttgcatttcaggaactgacattggttgtcttccctcttccctcatcagtgcaagtaggttggatctcatgatagtccatattcacataaccatgagaatcagagctttctctctgtcatttcctccctgtttatctgtagcaagaagaaaaaagtccgtcttaacagagactgtgaaagaataaatatagactttattgttttagagcagttttaggttcacagcaaaattaggcagaaggtactgagattctcccatatactccctgttcatacacttgcacagcctctcccattatcagcgtcccccttagagcgatttgttacaatcagtgaacctacactgacaccattattatcacccaaagtccatagtttacattagcattctctcagcattgtttattctgtgagtttggaaaactgtctaatgacatgtacccaccattgtagtgtcatactgagtacttttactatcccccaaatcctctgtgttcctcctgttcgaccctctcttgcctttaacctttccaagccactgatctgttactgtctataattttgccatttctagaatgtcatatggctttcttagaaaatacaaatggtgacttttttggcatgactttaataaacagaaatgaaaattggtgtgtgaatcaaaatctttcactctgtaaagggacttatcaggcggcacctgcatgtggaattatatcaaggtcagctttagttagaaacagaaggagagtcacctttgtgatgtcatttctccttcatccaagtaaaatctcgcatgctgacacataaaattttatcatcagtgatttatttcctcgtaggaatgtccctttgaccttattaaattcagatactctggggatggtcagcattttcagatggttcccttgttctgtaaaaatgtttgttattggtgtttaaaagctgtaaaagccacccactataaattgatagccattaaagtctgcgaatgtggtatgaatgttccactatgttgccaagcgtttattttattgtgagttgttatttgattgtttgtaaggaaattgttttatgatgctcagctttatatttccataaactgttcctcccttgcaactccttaaactgtgatgagcttttcaaaacaagtccacaggacaacagtctgtccagcatttgaagaagtggtggaaaagtcatttttttcctttcagtgtttctagctgttcatgaaaactgcagttaaaagttgtaatgttgttgtgtttggcattctttgggaagatgcagcattattcaaacaaaaccgtgtgctcttgttttaaatagtgtccaaatgaataattgaattcatggacatctaaatttaattccagaaatcaaagctatggtaataagaacttggacctgagttctcttaggccaagtaatttaattccttagccggttgaactatttattacgtgtctccgttcctggttattatgccagtaaattgctcaggcagatgcagggatggatgatgggcatataattcactctttttcacggctagacacataccagaatgcagatcacactaaacagctgtttttacaaacatggtttctattcagagctttaagggccacatccaagtaataacaaagaagcctggagaaggaacctggggatacccagggtcatgttttcaccatcccacctggaaacacggtgctgtccaaaccctggatggtacacttggacatcgtcattccagtcatggttcaagatcacgtgtatacatcatgatttaaagagaatactggtttgatttttcttcctgactttccctgaattttccacttaaattggaaaacagcgctagttagtgcccatgatttgattgaataagtaagagatctcaaacacggtaaattaactgatgacatgcatcaggtcatctttctttgattcaccagtaatacaacagtgagatcctacagaaaaatgcaaaggcagaagctcagggcagctgagcaactgttaaggattcttttgaaatgtagccccacgtagtaaactttcgtgcaataatttgggcagtcaaaaaaaaaagtcagttatttcacctcatttatttctacgaggagataaaggcttccaacatctgattttcagtgccagtgttttctgtttctcttttcacctatttcgtcctagtcttgtggaaatgttacaataactgattaggattttctctgtattaacacttcatttattaacatatgagtaagttgctattaataaattattctgcttaatcagtttctttttattctttagccacatgctaaacttcttcggatgtcttcacttaatatccttacatcatatttaatcagagttagaaaggcgttccacttgggggtcatacacatttttttgaaacttttataaacgccctttatactattcttgtatcctacgtaatcagagtcaggtgttccatggggatcatacacatctttatacaacttgtgtaacacatgctttaaatcctgaggtaatcagagaattcctgccattgatggattaatctctttacatatctttccctttcactctcagcaaaactacttatggcggtcctgttagactttgaaagcctttcaggtttatggaggagtcttcctttctattgtcgtagatcatggaatcatagtgttcgcttgtctcacgtgtttggaatctgatttcctacataatgctgtgctctcactacgagtccaaggcttcctgtggctacaaatcccgggttcctatcacttttcccaatgatgagcttctccttgttggccagaatcagctctgtggtaataattcccttctgctttctccctctcgcttttttttttccttctgggtacattataatgtcagcatagcagcttttaattctattactatggtacttctcgaatagacctgtggtagttgccccagaaaggttgaaaccccctgccacatctaggtctttctcctgtattggttttgtgatctgatcaaggacatctattcctctagtcctgctaggtggtatacgataggcttttactattagatattcaaatgctgtcaaccatgcctgccttgacaggtacatgatttccacaaggatttcctaataggcctttttaattttgttctagacatgcccttcttttgccatccaaatttgcttattttttacaaactatgatgcatcagcatgtaaatgtttaataccataaatatttctgatcctcttcccaatttcactgagttactggttatctcttgccattattctcagcatattgcagtggatctcagaatattttcccctgaccaccagcatcagtattacctgggaatttgaaatgcacattctcaggccccaccaaggcctcatgattcagaaactctggagctgcattagaaactgccacaggcacctggtgatctgtgttggtttttgtttgtttttaaggagacagtgtctttgtctccctggctggaatgcagtgatgcagtcatagctcacagcagcctcgaactcctgggctcaagcaatcctcccgccccagccttctgagtagctggaactacaggtgcacaccaccatgcctggctggtttttgtttgtttttaaggaggcagtgtctttgtctccctagctggaatgcagtgatgcagtcatagctcacagcagcctcgaactcctgggctcaagcaatcctcccgccccagccttctgagtagctggaactacaggtgcacaccaccatgcctggcttttttttttttttttttttaatttttttggagacagggtctcaccgtgtggcccaggctggtctcaaactcctggcctctaggttttttcccacctcagccttccacagtgctgggattacaggcatgagccaccacatttagcaggtaggtgatctgtgtttcaataagccttccaggtgattctgatgctcactgaaatttgagaaccactgaaatatttggttttctacaaaacataagcagttagtaaccatagggtacgcaactaaatagttccagcaggcatccctgaccacagggcattgcagatttacttaagtcagtttcatcttccacctgtgtgagttccagcaggcatccctgaccacagggcattgcaggtttacttaagtcagtttcatcttccacctgtgtgagttccagcaggcatccctgaccacagggcattgcaggtttacttaagtcagtttcatcttccacctgtgtgagttccagcaggcatccctgaccacagggcattgcaggtttacttaagtcagcttcatcttccacctgtgtgtccagtttaagctctcagttgcagtttttaaaccaatttccaccagcatatactgagtatccgctaccgtgcaatgcgttgcggctcttgtatgtgcactatgagaagtaattcccataatacggcaaactcagttttgatatccaccaccccactttttataatggactacatttttcagagcagttttaggtttacaaagaattcaagcagaaactacaaaaagttccctctacctctcacttccccactccccaacagtttcccctggattaacattttgccttagtatggtacgtttgaaccaatatcgatacactattattaaccagtattcctgttttaacatgagaggcgactttttgtgtagtatagtctcttggttttgacaaatgcttaatgctgtgtatctattattacttatgacagtatcgtgcagagtagtttctaaaaatcctctctactccacctattcatcccttccccactccccctgaaccactggcaaccgctgatctttttattgtctccgtaattttcccttttccagaatgtcctgtggttagactcatggcatccccttttagcaactgcagaaactaagaactgtccccaaggataaaaatttttgcagacccactgagctgggatttatacttagacctgctgaattgaagttttgggtgtgtttcttctcaaattgccaaaattccatatggacgacttttcttttccttccctgaaatgtgtttaattgactttttctgttatttgtgtttgccttcacagtgaagacaaagtagtagaagtagcagaggaggaagaagtggctgaggtggaagaagaagaagccgatgatgacgaggacgatgaggatggtgatgaggtagaggaagaggctgaggaaccctacgaagaagccacagagagaaccaccagcattgccaccaccaccaccaccaccacagagtctgtggaagaggtggttcgaggtaatccaccatttgcttggattccccccacccccaaggaaaagaaagcgtaataccagagttggaaatatccaccctagcaccactgccttccccaatcaaaaacatgtttttttttccaaaaggcttcttatgcttgtgaaatttttttggtttaacaagcaaacaatttcaaataatgtgaaatctttattatacagtttgttttgtaccttgtatatgctgcttggcaaatcccaagttaattctacaagactccgcccaaccaggtagtcatctaatttgacaaacactgagttaggtgactccttggtattcctttggcagtgagtgtttgttatataatattgtctgttaccacctagacgatgagctccttgagggtaaggacttgattttattcagtattgcacagagtgcctggcttgtagtttcgataaatcttagttgagtgagtagttgtgattagatttcattaaagaaggagatttgggccaggcacagtgcctcacacctgtaatcccagcactttgggaggccgaggcaggcggatcacctgaggccaggagttcaagaccagtctggccaacatggtgaaaacccatctctactaaaaatacaaaaatgagccaggcgtggtggcacgcacctgtaatcccagctatttgggaggctgagacaggagaattgcttgaacccaggaggcggaggttgcagtgagctgagatcacaccattgcactccagcctgggtgacagagcaagattgtctcaaaaaaaaaaaaaaaaaaaaagatttggtgagtatcgcattattttatgctatgaattttaacagaggtgatttatgttgagtttacattgttttattgggaagtacggcagtgctttcttcaagaagtaaatatagtattaatgtcttagactttctctattgaattaatgtttgtgttgcaaatattgtgaactaaaagaactaaaggtcatacttgtctccatgaaataaaaacaaacattcagttgatattaaatgaccaaatgttacagaaacgagtaaactgttggattgagttccttaaagagtatgcatttgttccttaaagagttctgcatttcatatctgccatctgcttggcagatagtaaaagatgcttctagagctagattgaatgaatatgtacttgactgaattttaatgtactgcaaatacttataaaggtcaaccacaaatgttacagcatttacaaaaagtggctttctctcactttttgctaaagtttaatgatttcagatttattgttctattagagcttaacatgggctattttgtctccctcaactatattcatagttgtcactatagtattttcttccctttgttgcattttttaccttattaaggtgtaatttacatataagtttcatttgcttttaagtatataattcagcggctttaagaaatttgccaagctgtgcaactatcaccataatctaatcttagaacattttcgtcactccagtaagatcacacatactcactcccagttaagccctctactcacctctagccccaagcaacaactaatctactttctgtctctatagatttgcccttttttggactgttattgtaagtgggatcatataatacatggtcttttgtgtccgacttctttcacttaacacagtatttttgaggttctacatttctttaacttgagcttttaaaattgagattattctgaattaaacactcagcgttagcttaaaatttattgaaagttttacatgttctttgaaaaaaaagaacagagtgcaagatggattaagtttatcattccctacttaatgacagtttcttactcactttagcacataagtaaatgtgctagtaaatgcgcattttgtttaaaccaccatttttcaaatactgagacatgctttctcagggtgtttttcatacaactgttaggaccaactatggcagatctggtcaaatgaacttgttagcctgatgcctgtagcagggaaggacagcttttcagggcttctcttctcgaaacctaaatgaagtgtgaatacaaattacagcagctagcagcctgcagtgggactgaaagtccttggtgaatctccatcaagctgggctgtttaatagaaccagtttagtgtcccattttacttgaaacattagattttgagcacctgcttggtacaagccattttgctaggccatgtggaatggatgatgagcacacacagaccagctaaccctagtggatgttaaaatctcttaggaaatagaagtcaaagaagtacaaagccatctgtgttgtaagaaatgtgaacacagaacctgcctccgagagtaagagggaacttctggattgatcagagaaggttccatggagagcatgacatttgaactagagccaaaagtgtgggtgggtggtgtgtctaccagtggattttgctgtagagtcatcaggactagcaaaacaaatgtggtgccatggaaaggcatatttaggagacaggattggtccaatttaagctagagcagatgtcttttaggttgggaccaaaatatagagaccttcaatgccaggctggcaaagatgggcattaactgcaggtgattaattaacaaatattaattcagaagctactgtgcgctgcagatttttccaggagacaataaagagattttgttttgatgctagtactgttgaggtaacaggtgaacaaggagtgacatcagttatgcagtacaatgagaggatgccacataaacttaggcccatattctagaacaagacaatttgcttgagataaattggtctcattatcgtctgcattagtccagttctttttgcttgagttttgcaggtagtattatttgatattaagacggaacacagagatgttgtattgttttatttcctgtagaaagacgaaggcagttaaaagaatttcataaacaaaacactccaggctaaaggcaaaaaagaaatgaaccttaaaaaataacaagttaataattttgttggcaagaagagcaacaaaagcaaccttctgaaagcaagatacctggtcattgagagatagcaactgttaatgccccagaaatagaggaatctttaatgcaggtccattcattccacctcaaactcctgaacaaaagctctaattgaggcaagtcttcctgggaaagggggcctaacagaaacatgttatggtcagttgtgcccatgcgagataatttttttgtgcttgtagctaattccagtaaagaagtagatgttttagagggtaacgttaaaggggtcagctgcaaagagtccttttcctcctcctcactgttacaaaaggtgacttgtggttcttccctaattgagagcaatggcaacgccataggtgattactcattttgtaaaactctaattacaagtaggttgcttctgtgttcaacataaaaattagaagtgacttgcaaagatgagatactgcagggaggcttacaatcttgttttcagtgttagtgtttcagtacctggaacaaaatgtgatttacagccatcctttctaagaaaattgtcatcattaccaacatattgctactgataccagtccttaatgtgcttcataaaaaactcaataatttcataacccgttaaaaccggaaagaaatggagggaagaaaaataagacacttttagcgtagtcataatcttctctgccatattgtgttagaatcgatgatacccaaatgagaagatgtctgttctctgtcactgattccagtagaataaaattattgtttaaaagtaagcacattcgctgcactccagcctgggcaacagagtgggaccctgtctcaaaaaaataaaaataaaagtgagcacacgattgcaagatctatctggttttgggggcttattgtcatctttggttgttaaaaaaatacttggatattattggttattggtctagtggaataagccattaccgatttgagtacaacagtggtgtatttagatacttgctcctaattttctgttcttcaagaagggattgtacttcagaaaccagagatatcagggtagttttgattgagccataaattctaaattctgattgaaatgggtattgtaataaatggcataatcttttatttaatctagccaattgtgccctgtccagaggaactggacatttcttccttatgttccatttattcagcaactattcgttgtacccctgctgatggctaggctctttgctactgtggaaggcatcgttggggcagagcagacagcattttacctcctgggagactggcagatttttgaagcctttgttgcagatatagattttcacggtcaccactcttgccctttaatgtaatttaaatttttttttttttttttttgacacgggattttgctatgtttcctaggctggattcaaactcctgagttcaaacctcagcctcccaagtagccgggaaaacaggcctcttgtgctttaaagcagtgattctctgtctttaaaccttgtaactatgctgtgtggtggaaattttacttccccgtttaaagccaagatctctaaggccaagaattttttttttttttttttttgagatacagtctcgctctgtcacccaggctggagtgtagtggtgcgatcttggctcactgcaagctcggcctcccgggttcacaccattctcccgcttcagcctcccgagtagctgggactacaggtgcctgccacgatgcccggctaatttttttgtatttttagtagagtcagggtttcaccatgttagccaggatggtctcgatttcctgacctcatgatctgcccaccttggcggcaccccccgccccccgccccccgccccccacaaagtgctgggaatacaggccaccatgcgtggccgaaaaaaatttttttaattggcctgggctgggcgcaatggctcatgcctataatcccagcaccttgggaggccgaggcaggcggataacgaggtcaggagattaaggccatcctggctaacacggtgaaaccccatctgtactaaagatacaaaaattagccaggtgtggtggcatgcgcctgtaatcctagctacacaggaggctgaggcaggagaatcgcttgaacctaggaggcggaggttgcagtgagctgagattgtgccactgcactccagcctgggcaacagagcgaaacttcgtctcaaaaaaagaataaaataaattgtcctgggtcacataactggttaagtgatgaaatcagaatttggacctagataggccaggatatttctgctacactcatgtcaaaattacactttttattttctttataaatacacacaaattcatttcaacctgtgttcccttgtaaatgcatatacctttgatataggcatatattcatctattattttacactgtgcatttctgaatttttagaatttttacttgaagtgatcaggctggcgctgtggctcacgcctgtaatcccagcactttgggaggctgaggtgagcagatcacctgaggtcaggagttagagaccagcctggccaacatggtgaaaccccgtcttcactaaaaatacaaaaaaattagctaggcatggtggcgcgtgcccataatcccagctactcaggtggccaaggcaggggaattgcttggacctgggatgcggaggttgcagtgagctgagattgcgccactgcactccagcctggcgacaagagcgagactccgtctcaaaaaaaaaaaatagaaaaatgatcgggggtccacaaataagagtaatgatcaagggtcagcaaattggggccaaaaatagcctgttttcctgttttctacacaaaagttttattaggacacagcccatcccatttgtttaaaaattgtctatggatgttttcatgttttggaagtagagttgaggatcgcaaaagagattgtgttgcctgcaaaactgaaaacatttactatctggccttttcagtaaacatttgctaacccctgattctcactataagacggtgactgtgaagttctttctatttcacatactgccatatcaagttgatttcttttgaggtagggtttgtttttttttggttagagatagactagtatagtgtttgagagaatttttatgaccttgggccagttaagtaacctgttttttatgtgtgtagtgtagatggtaatgttatcttgcatgtttcttgtaagaatgactttaggtaacttatgttaaacgcttaccatcatgcccagtaagtgttcaatttacaaactcaagctgtccagattcaaatctttgccttacaagctactaactgtgtaaatttgtataaatcaaataaccttgaatcctcattgcttctttttgtaaaatagggattaataagacctatccaatatttaactattttgtgaggattaaattaattaatttataggaaacactttgcataattcctggtatacagtaactgctcaattaaccttagttgctctcttagttatggttataatcatcattccgatcctccattgcatttgaaacattagcaaactaatgtttactactaatgaggaatgttaaaggtaaaccaataagttgacttttaattataaaaggcataaatgtaacctatccatatctattggtataataaagctgatatttagagagaacattatgttatgattaaaagaaacatttcttgcttaaattttttttgtgtgaatatacactgtatattgaaatatctgcacttaaattttaaatccagctgaaaattggataagatagtattagatgccactgcatttcaagatagagttttatttcttgcaggtattttaagccttgtgggagttcttctgttaagtgaacagatagagacactgatacagatggctctttcaccgtctcatgtgatgataaaagctaaaaggtttgatccgaatattgcttatattgggctaagtgattgaccttggcagaattaaattatttttcttcttctggtgacaattaatctgggagaagtaccatttgatttattgctatacatttcaccaatatccacaaggcacttgtaggtaccagacatggcattggttgctgggggcacagagataggaacaaagtggcttgctcaggttgcttctagccatatctgcattgtccttgagagggatgagtctctcaggcctgcctaggaaggaattttggcagcatggagaagagaaagtgctcagcccggaacaaaagttttcacctactatgttgcagagaagttggcgtatcagtaattataaaggaagaatagggatttactgggtgatagagcaccaaatagaatgaatgcaatacatacttgaagtaaatcagagtagcttgtattgatctcaaggggagaagaaacaaagcttagcttaattctcatgcctctgttgttacttgtttgtaatggacatgacacttacaaggtatcctataattcactaacgggatttttacttatgattaatatttaactctccacaaagcttggggtaaactgtgaacttaacttgctgtgaacccgaacatgaactcacatacttcagttggaggcctcagtagtagcatgctgtacaaaaatgaaactaaagctccagggagtatttgggaacagggcaaaagggtaatggctcctccttatagagcaagcctcaggcctttacctttgtgttttgaagatggagaggatgcacttctactcttcgcccgggttgtagcatgcttgctaatgatgtcaagagaactagtgtcagcactgaccatagatgtgacaggtaacagcctgttattttgtgccccatgtcatggcagccattgattccgaggtgtttgatacacactttgatagaggcagagtgaagcaggacatggacaagcatctttccgtgtagtttaatggtctcaatctagaaagcccactcagataattaggttgcttaaaatgtgatgagactagggaatagagccatatagaagtgtgtgtgagagagaattcagtggtttagtatattcacaaagatacacatttgacaccagcctgggcaacatagtgagaacctggctttaccaattaaaaaaaaatagaatagcagaagtaatcagtgaaaggcattttaatacaattatatctagatttattaaaaataaaattttagtccaatttaattaaaggccagaaactagatttttaaagaatattagtctttctcatattttccccaaatcagttgctttaaaaaaaaaaaagtgtgcagatgcctcaggcacaataactgtactcaactcaagaatttgcaattaagaaaaaaaaaaatcaaacctcaaagaagaaatccagcaactcagaggttcaggttcatttaaacatgcatacatttacatgggcacactttttttgttttgttttgtttttaagatggagtttttgtttgtcgcccaggctggagtgcaatggcgcgatctcggctcactgcaacctctgcctcccgggttcaagtgagtctcctctctcagcctcctgagtagctgggattacaggcgcacacaaccgcgcctggctaactgttgtatttttagtagagacaggttttcaccatgttggccaggctggtcttgaactcctgacctcaggtgatccacctgccttggcctcctaaagtgctagcattacaggtgtgagccactgcaccagctgggtgcacctttttgtttgtttgttttgttttgttttgttttgttttgttttgttttgttgacatggagtctcagtcacccaggctgggattcagtggcacgatcttggctcactgcaacctccgtctcccaggttcaagcaattctcaattctcctgcctcagcttcccaagtagctgggactacaggtgtgtgcaaccacacctggctaatttttgtatttttggtagagatgggtttcaccacgttggccagactggtctcgaacttctgacctcaggtgattcacccaccttggcctcccaaagtgctgggttactggtttgagccaccacacccaaccgggcacacgtttttagccaagccataggtctgattaagtacagtcagattccttgagcaggttacaaagctgtggatttgaatggagatctttagttcccttgcagaacaatgagtttccaaaagcagagtggcttacagcctaaccagctgcttctctcagcctttaaccattttgccctcctgaaaattcatctttggtttccaaccacctcttccaatatgcctgactttttgtgattctgttagtagaagagtaaaaagtcaaggggaggcaagaatgaatgaatctcatataaaaatgatgctcaagagaatcccttaattttcaagacagcagcccaaattgtaaacattgagacttttacagtgttaaaaaaaaaaaagtgtttacaggccaggcatggtatctcacacctgttatcccagcactttgggaagctgaggcaggatgatcgcctgaccccaggagtttgcaagcagcctgggccccatagggagaccaaaaaaaaaaattgttgttttggctgtagtgtcacaggcttatagtcccagctactcaggaggctgaggtgggagggtcgctggagcccaggtgaggtcaagcctgcagtgagccgtgatcacaccaccacactccagccttggtgacagtgagaccctgtccaaaaaaaaaaaagattaaggcagaggaaatgttaaaggttacgctatatttagttgataataatggtaagactgttcaggtgttttaactatgagagtagggttgcctctttcttaaatttatatatgttcttattgggtataatttctagacagaatatgcaagtatcacagaatatggatggcaattttatgttgcttgcacgtgactttaggttcttatgtttcatgataggagcaaagaaaagtcttgcttgccaattcttatgattgcatctgttctggaaatttactagcatttgttacccaggatttctgaagtgctggtgactgctgcccagtagtcttggtgggcaaagttactaaaatgcatcacgaatccttctggtgtttgcttgggctatggcagggtttctggaccttagtactattgatgttttgggccagataattgttgcggatgattgtcctgtgcattgtaggatgtttagctgcatcactagcctctactcgatgccagcagcacccccaagtgatgacaatcaaaaatgtcccctgggaggagtaggggatagactctctctggttgcaaaacactgggctatggtgttgagatctgcagtgatgagcagctttagatatgtgaacagaagcccaggcgtggtggctcacacttgtaaccccagcactttgggaggctgaggtgggcggattacttgagatcaggagtttgaggccaacctggccaacatggtgaaaccccgtctctactaaaaatataaaaattagccgggcatgatgatgggtgcctataatcccagctacttgggaggctgaggcaaagaaatcacttgaacctgggaggttgaggttgcagtgagctgagatcgtgccattgcactccagtctcggcagacagactgagatgccgtctcaaaaataaataaataaaaataaaaaagtgaacagagaaatacccgtgcaatactgtgtctcatcccccaaagacggagtcttgctgtcgcccaggctggagtgcagtgacacgatctcagttcactgcaatctctgcctccatggttcaagcgattcacctgcctctgtctccgagtacctgggattacaggtgtgcctcaccaagaccagctaagttttgtgtgttttttttgttttgttgttttttgcttttttttttttttttttttttgagacgaagtctcactctgtcacccaggctggaaggcagtggcacagtcttggctcactgcaacctctgctgcccaggttcaagcgattctcttgcctcagcctcccaagtagctgggattacaggcacctgccactgcgcccggctaatatattttttttttttgtagttttagtagagacagggtttcaccatgttagccaggctgatcttgaactgctgacctcaagtgatccatccatctcggcctcccaaagtgctgggtttacaggcatgagccaccaagcccggctggtctcattttaatgtaagctctaacttctgtatcactgctttgcacattgtagataaccagtgaacattttttattgtataagaaaaagtaaaataaacaaaaatatgccaaagcaaatatgataaatacacatttagtaaggtaaaagcaagtatttgataaaatgtgtaatgtagtctagtagctttatttagaaacagaaaacaacataaaatgttgacttgaaacattgcgtatgcatatttgccatgtagacagtgagatatggaggtaaactgctttcctagttttgttttgtttttttttttttttgttcaaaaggaattcactctccccttgtccactgttataaaatagcaaatggtgattagcatctgtgctgtaaccagagacactgctgttcccagctggaatctgtaggttgtttgcctgctagagattgtgacaagaagccagttaacatggagaggtgtacatgtcagtcttccccagaaaaggacatgaaacagtaggaccatccttccaacccatgacctacatctagaggcattctttttttctttttttttttttaaaccggaacagaaatatcatctaattctttctttacagagaagtggtataaggaagtacattctggccaggcacgatggctcatgctgtaatcccagcactttgggaggccgaggtgggtgcatcacctgaggtcaggagtttgagaccagcctggccaacatggtgaaacccctcgctactaaaaatacaaaaattagccgggcgtggtggcacacacctgtggtcccagctactcgggaggctgaagcaggagaatcgcttgaacccgggagacggaggttgcagtaagccgagttcactccattgtactctagcctgggtgacagagcgagattcgtctcaaaaaaaaaaaaagaaaagaaaagaaaaaggaagtatattctaagcccttgaattgatcttggctttcttcattatttttacaagtaaaaataaaaactttgatatttctgatgttctgggatattataggaatgataccacttgaattcagctttctaagaagtctggtattttcatagtcttaatatgagtaagaaaattatgatcttggtactggatctaaggcagaggtatcgaagctgttttaatgttgcttgagataggacagaacttcagagtaaaataaatgtgtatagacaatctgttcaatctgttcaaattaagttgttgagctgtatatttgaatcttaagactactaattttgttgtatctgtcttttcccaaatatatgtgtacttcttttaataagccaaaacctatgcaacttttactaattcttccctaactacttcttttggaaaatgattaaatcttatgtctcacgttttgacatatctattgcatttaaaagataaggttgatcatgctgcttctcaaactgagatatccattcgagttatccaaggcccttggaaaacaatcgttgttgagtctgtatggggggcctgagtcccaggtggtgttgactctgctggtccatgatcctattttgagtagtagactctagtagcgtctcctgccttccatatggtgcagatttgcagcattgagacaggaagtaagaaactgaaaaggaaaaccattcttacctttggtgttattgttcttggtatattacagataccaacaagtatgaggcaatcctgagacatctacctactgagcttttctttccttaaattcacacctcaagaccaaggaaaccgaaaaactcttacagtctccctacatgtgttcacttgtgcccctatttcctgtcattaacatggtagtgtagccaactcctgctagcctgtaaaagctaattattacagtatagaggaattttgtaagccatagccattagtagcttgaaataccaatggtgggagtatttataccatggcagttggcatacactgtaactcaagagtgttctatttgtttgtttttctagacagtgccagtttcccagcatactcctgtctctcattcagtaagacaaagcacttccccttattttccaatacaggacatgatatcccgagttttgagcttcttgttaatagcctgttgcacgctaaccacgcagctcagtgaagagcaagtttattcccataacaaacaggaaacaaaggttgaggaaaaaccacagtggtacccttttgtgagtgttccctaacaccgtcacgggagtcctgattagtctaaatactttacaagtaaatctccttcaggtggcattttataaacaatctttcatcatggagagatgagaattgggtcaggtataattagaatgacagatgtattggctagcctgagagaattaacgcaattcagtaaaaaggctagccaactgcggatatcttctagttacttccgtgacaaattagcaccatcctcttgtactgaagcagtgctttcattagcatgcacagctgtttgcatcatctttgtttgtatttcaatccatatttggagcttaagtgagatttgtcataagacttcagttcaagcttgcttgcctaattttacatgcttctatttagtaaaatatgattactaggtcataaatatttgataatttattgccttattagagtaattttctaaacatgttttttgacgactgcttgccactacgtacaagcacttgaaaaatgttcttttctattaaaagtacatggttccagaattgggaaaatcacgttcttaaaaaataaccagttttctattgtgttggcttttaaaattttttcatcagtagaatcaaatgcaaatattgtctgcttatttttcaacagaatacaagtttgattttaataacttaggctcatgaaatgtcaccacgtagtaatacttagaattacagcaataacttaggctaaaaaaataaagttgttatgaactacattgagctcagacagatatatgtattatgtaaacatttatataaaatgtatataaattgtatattgtattatataattatatattgtaatatatagtatataatatataatttataaatataatacataaattatatttataaattataaagtttttatataatatattataatctaatatattataattatatttataaattataacgtttatttgaaatattgaagttttgtatacttagtggattttaatatttatgtcgttttcattttattccactgttacattaaggaagtaacttattacaaaaataaattatatttgtcttacatttgccctttttactctacttaaaattggagaaaaagagttcaagatagggaatttctgtcagaaaggagaaatagttgtattatgtgaagtttaagtagatattcttgtagagtatggagaaaataatgctataaaatgttgccttttaaaaaaaagttcagaaaatatagttcctagctctctctaaatgactagtttgattgtgactgctttcccaaaatttgtaaatttaaaatttatacatcacatggaatatagttttatttcacatacattccagtaggctgagaatacttgaaattcaatgattaaaaatgaaataataataaccagctttgctttattctaaaaccagctttattctttatttaccactttatttacagcgaattatttgctaatctgttaactttgcttcataagaaggcattataattatcgtacatttgaaagtggagattttctccccattctggttgccagtttcacaactgtgttcattctaaatttattaaaatatgtaaaatcagctttctaaccttggttgtccacaaagaatttcactccaatttgaaatatctattcagaactaattttttgtggttgagcattattttttgaacaatgaattgcataatcattttgtataatccagggagctctggcttagattctgtattattttgtgttatactgatttttagaaaatggaatgtagcgttgacacgagcacaaatctcagcaagggcctaccttacaaagataaaatgcgtggagttttattagaagcacatgattttgctttgtgtttcgtatacaccagcatttcagtgtagtaaatggcattttgtcttgaagagtgagcagagttgttacaaaagaaggcataatgcttccttgccagcagaattcagataagtgaatatcagaaaagctatttgtgatcttgaaagtgtaagaaattcaacatcaataaaggattgtggttccttagatagccatgtaagtctttgcctatgtttctaacatttctctttaggaaatattcttgcttttatttttctgaacaaattttctccattattatctctgatatttactttgaacagaaaggtggattggaaatcaaaaaataagtttgatttcaaaaatgatttcaaaatgttagttttctcagtattttacattttgagaagagaacaaagaaggcagatgaagagttttttgttttttcttaaatttgttttcttttcaactttatttttaattgacataataattacatatagtatacattttgaagatacggttttaattttcacaggaatcttatttgggtttagttatataaggtctaattttgcatcctctacatttagtggctgatttataaatttccactgagtgataatagtaattaatgtgaaacaggttttttgctgatgtttttagaagtttcagtagattaggaaggaagaaattatgctattgagaaaaatagaaaatgtaaacataagcatttgaactctctcttgagatatttttatcttccatgaaactagatgcggcttattgaagatgtgtttcaggtctcagtgctctaaaactcttctacttggtgagcatcttgattggttagatctcttactaatatcccattgctagagagggatgtaaaggaaattttctcaaactgagatttccaaatcttccaatctctgagtcaagtaaagagacaaggttagaactcttaggcaaactgaaaaatcaatattcctatattatcattatttttttctttttttgacaccaagtctcactctgtcgcccaggctggagtgcagtggcactattttggctcactgcaatgtacgcttcccaggttcaagtgattccagtgcttcggcctcgcgagtaggtgagattatatgtgcacgccaccatgcccagctaatttttgtatttttagtagagacagggtttcgccatgttgactacgttggtcttgaactcctgacctcaggtgatctgcccacctcggcctcccaaagtgctgggattacaggcttgagccaccatgcctggcttcctatattcatttttttatgtgggctttttaaaatcttttcaatagcaaagacttgacaccaacccaaatgtccatcaatgatagactggattaagaaaatgtggcacatatacaccatgaaatactatgcagccataaaaaaggatgagttcacgtcctttgtagggacatggatgaagctggaaaccatcattctcagcagactatcacaaggacagaaaaccaaactctgcatgttctcactcataggtggaaattgaacaatgagaacacttggacacagggcggggaacatcacacaccagggcctgttgggggggtggggggttgggggagggaaagcatcaggagaaatacctaatgtaaatgacgagtttatgggtgcagcaaacaacatggcacatgtatacctatgtaacaaacctgcacgttgtgcacatgtaccctagaacttaaagtataataaaaaagaaaaaaaattaaaaatcttttctttgagacaattgtagatttacatgcagttgaaagatttaatagaggccgggcgcggtgcctcacgcctgtaatcccagcactttgggaggccaaggcaggcggatcatgaggtcaggagatcgagaccatcctggctaacacagagaaaccccgtgtctactaaaaaatcgaaaaaaattagccggtgtgtggcgggtgcttgtaatcccagctactcaggaggctgaggcaggagaatggcgtgaacctgggaggcggagcttggcgaagcctgcagtgagtggagatagtgccactgcattccagcctgggcaacagagcgagactctgtctcaaaaaaaaaaaaaaaaaaaaaaaaagaattaatacaaagagaccctgcatagtcttcactcagtacagtatcacaactattaaattgacattaatcccttaacactgctttaacccaagtctatgctgctgcttctccgtgttcacttctgagaggcactggccatttcttgtgtgcttattcatactttgtgtaaaagcattagcatcatacatcgctggtgctgaccctaccctcagtcccagcttctcccagagtaggctaagattctcttttctactacatggaaaattgttctggaataataaagggttagcaaaaaagtcagagaaaacaaacagttgcattccctttccctgtagtagagtaggaatataattatgagtgatagaggatacgttccattcctttcccagtcctctccgaagtcagcttcactgctgtaggaagttgctgttctcattatttccctgagggaaagtgttgggaagtgagagttgaggtgatggggaatcagggttgctgacaattgggggaattataacgagaagctctttttcaccaggagaggggttgcatgttaagagaaggcctatctgctcatcctccatgtcagcagatgagaaccagttggacaaggtagctgtctcttagagattgagaagtaacaaaagcacactgtcagtcctgttcttccagcctcacgtacatcttctccatacattatgtatttgacattaaattaacatacactgttacacccattcctgaccgcattatctcaggtagccttttgtatttgagtattgtgggatctgttgctattgcccatgatgcccacttggactccaccaaggcagtgaaactcttgggggccgttcaaagtcaagagtgccaactgcccctaacaggattgggagaaccaaccaacactccccgaatagggactaactcactcttttcttggcctttatgaaaggaaggagttaaggctcttacagctggagactccagcaagagttgtaggctcaacgtgtagcttatactatttacttaattaacatgtaaatggattttgagttctgaatgcttgttctagttgattagggctcatttagcctggcttctacgaattagctataacaaatggtttcatagctgttatagaatgaggcagaagaaaataaaatgaatgtagcattatgtttaattagtggtataggaaaatgttaatataatgccatttagattctggactggggagattgtgcctttatcataagtaagaaattgttgctaggtttcacataagggcacatagttatcatgaatcatctccttcgatcatcattcttttatcccattacttgacttgcacccatccaaaattctaccacttttatttaatatatagactcataaagacaaggtttgtgcatctgcagagctgtgatgttcactgcgaggcccgtggcacacatctataagaagacacatatttggtactctaagatgatacttttttttaatgccaaaatgtgagggtcagcataaattgccaaggcatggtaaattttgttgccaatgctcccgtgactatggggtgaagggattctgtgcctcccttggtagcaatgaccacggtgcttgcaatcccagtgccaattcccggcacagtgcaggctctggaggcactgctgccttgcagtcttattggaattaacactgcctgagtaagagattaataatgggtattgttgtgtcttagaaacgttaaagagcatgtgacatgaatatgtacacattggtgaaggagatacagagaaggaaagcaaagtgaagctgtagatgtttgttacaactgaaggtaagctctgggagcagagaccactgctggctatagttgatgggatcctcacatctaggcatggctttgagcttcacaggccagaagctgctctgtcagtaactcagaggggatatggtccctagaaccaattcacttttaataaatcagggtgccagtcctttaattttggaagataaataaaattgcgaagtagatgggatacttacgtcaacaagttggttgggtttcatcctgtaagagtattgtgtacagaaatccaatttgctttgggagcgtggactttgaaagcagcagtactgagtgagatggccttaatgatggatgataatgaggttgatgctttcgtagccacgtttccatctgaaaaccacgtgaagagtgtcagatcatcttcatgtccgttgcatggcgcatttctcctgcggagtgtttgacaccttctgggcttagtgctgactgtccctcctgttgacatcatcgtgatggtagccacctctggttttaccagtactttattgcatctactgaaagagcaacgtgtatagggaagtaaaacaatagttagtccccatttgtattgacattgatggatccttgtctttgattggctaattagaatcaatctgttgaaggaccagtggcagtggctcacgcctgtaatcccagcacttagagaggctgaggcaggtgtatcacttgaggccaggagttcaagaccagcctggcctacctggtgaaaccccatctctactaaaaataccaaaaaattagccaggcgtgctggtacaagggtaatcccagctacttgggaggctgaggcgcaagaatcacttgaactcaggaggtagaggttgcagtgagccaagattgtgccactgggcggcagtgcaagaccctgtctcataaaaagaaaaaaagaatctgttgaatattcctaacttggaagtaatgggtgatgcgtggctttcatcttttagaaaggtgttttttcctctgtcagtaaaactaagaagacatctgtgtgtgctaaggcgtcagtctagcaagggcagggcacaaacccagagagagaattgggctgttgtttcacttccaataaaaatgggatatacatgggaggtagagttataattctactcaggattgactttatacatgcaattggatgggtcactgattgactttgaggcaatcagggatgagtgaaactgatcttggggagggtggcaagacatgttgacaggtaagatgtgttttaatgtataacagtgcgtggtgtgtattaatcagttggagttgattgactgcgttttattgtttggaacattcctgcccaagggtcaggtaaatatacaaaatatacaaataatacagatttttaatacataaatatcaattaagtagcataattaaataatacattgttatagttgtacttaatgtgtatgtaaatatatacaaataatacagatttttaatatataaatatcaattaaatagcagaattaataatacgttgttatagatgtacttcatgcatatgtaattaaattattaatgtataatatataaatacatattttaatatacaaataaaatggtcttaaatcagagttaatttaagaccgtttatattagtacatatcttaatatacaaatgaatggtcttaagttaatgtcattgagtataagtcacatttacagatatgacatgtgtttccagataaagtcaatggacagacagcttccaacactggaaaacattcaaaatatatgcaattaattttatatttgagttaaggcaatcatttattaaggaaagcaatcagatgtttgtgagggcttaaactttcgcttcataaccaaagcagtttccttacatgaaagttgacttcttaaaaagagaagtttattttttatgatggaggattgttgtgatgtgcagataccttccgtcatttcatactcatctaaaagcagccaaatgatcttttcacctttggccggaatccttttattgctaccgagtcctgcactcattaaaccagatgacagtgcatgctctgagaggtgtaaatctctagtcctggtggccagttaaattcctcagtaaatgtttggtagatgctgcctaataaaccagtccaggttgccactgggaggattaaaagaagtaaacgtgtatacatgaacagagagacagtgccttttcatgctaaatgtggttccccacatctcctctgattagaggtgtgctctgaacaagccgagacggggccgtgccgagcaatgatctcccgctggtactttgatgtgactgaagggaagtgtgccccattcttttacggcggatgtggcggcaaccggaacaactttgacacagaagagtactgcatggccgtgtgtggcagcgccagtaagtggacccttcttcgagcctggccacctttcgtctctctcgccactgactctgctttttgtaacagattgattttcctggttcttgggaatgggcctgttgctaccactaaccacatttctgtccacttctctaattgctcagagtctccgcagtatgttcaatcatgagcacacctctccgtctttccctgataaagcatggccatggatgtgttctcttcctagctgtagcacatatgtcttgcaatccagagggacttttgagtgcttctcttttaaacaaagctggagtggctgttttgtcttctgcagccagccgtttctgcaaatgcatacttatgtgtttgtccgtgtacatatgtgttcatgtttatgcatgtgcactacctgtgcagatactgtctaccactggaagcctggctgatgcagcttgagttgcattgataaggtgtatggctgtgatgaatacctttaagttggttcataacatgtcttttattgtgctgatgagggaatgtgattgaattgagctcatgcatctcaaatgccggagggtagaagtgcccgtcttgccccctccgagctcagcacacagacatttgccaggtcaaacttctgcttcttctcttgaaagtagaagaaaacttttgacttaacgtgagaaactttcaatgacataaggctcgaggaacataattttattttttttgtttttttaaagacagggtctcattctgtctcacaggctggagtgcaatggcgtgatcttggctcactgcaacctccgcctcccgggttcaagtgattctcctgcctcagcctccccagcagctaggatcacaggcacatgccactgcgcccggctaattttttgtatttttggtagagacaaggcttcaccatgttgaccaggctggtctcgaactcctgacctcaagtgatccacctgccttggccatccaaagtgctgggattacaggcgtgagccactgcaccccgccagaacataattttcaaagtctttctcttgaacattaagcttttcataattccgggggataaaaatatgaagtcatgatgacttaagtgcatgatgaaattttccccaaagaggtaattctcaggaggtccagtaccagatgtgagacttccatgtcgttaacagacttccaagtgaaattcccaattgtgcttatttatttatttatttatttatttgttgttgttgttcatgagtaggaagtatgaactactcaagaagtaattattcagctcagcttgataactaaaaatgaaactcaataactgtgtattacttttttgagagactcctgcctaattctccgctgtgttgcaagggtggcagccacatttcctgcctgagattcctagggattatataaattgttttgcagcaagatcttaggattaagcaaaacaacagaagggcctgcaccattaatacccccactgtaaaggagcccaggatctaagaggaatgtaatggaaaagctcctgttggtctcctgccatcgccagtgaatgagatgactgcttcagtcccatgtgtgaacaggtgtaggaactgataacctcaagggctttttttttttttttttctggctctgattggatgattgcagcttctggatcaaaggactcccttcttcagtttcaaacaaagcagtcaattaggtcaggtattgcgaacacaatggagaattctgttgcctgcagcctttggaacaaaggccttttgttacagtgattctcactggtttagccggtgggagaggtttcctggcagatttgcaacttttttctccctttccctgggtggattcattttctgaaatatcatgtatagtttttggtaataagagatttatttggttttaattattagcagtgatgaatttgcttcaagagattaaaattctctccacctcaccccagtactgccatcccttcacctaacactctctccctttgatcagtttgggctgggagtgaccagtgggcacctgtccaggtgtcctgggtggcacacagtttgctgagggttttgcaaaaggtcgatgctcccaacagagatgtattagatgaggctagctatgcctgattttagaggggaaaggtgacagaataatgtatgaagaaggcaaaggctgaagatcagttagatgggtggacaagaataagtagagagtataagcctcagcaaacagccagagccgagagccacatgctgtcctatgaatgagtgaaataaatggagtttttgtgaaaaaatgcatcgaagggaattggggatatttggcacaaaaggagcaagaaatcctcttctgttaagaaacctgttgttactcggatatactatcagagacaaaatatccagcattctcaaatgttaacttcttacgaaaatagatcttatgtttatatgttcattttggttttgttggagggaccaaacctaagtgagtgattttgtttgttaggttgtttttttgtcagtggactcgtgcatttcagccatcattcccatgtttctctttttgtttttagttatgttctcttattttttccatagtgtcccaaagtttactcaagactacccaggaacctcttgcccgagatcctgttaaacgtacgttgtcattcacctgagggaagggaagaggggaggaggatgctgcttggttcacataactccagcatcatcaccttctttgcatggttttgtgtttcttgaacacctgtcttagtaaaatgtttcttcccattaccttgcttgtaattacatctgattttgccagacagcttgagatgttgggctaagagcatcattgactaagtttcttctatttctgaccaatttcctttttatttagtctggttttattgaatattatatggacaacatcattgtattgtatttgccattactattttatttcctaaaagctatcagtgtaactgagagcaggcttagcctctcactgcttttgcagaactgaagaacaagggctaggtgcagtggaaggaaagtgactttacttagcaaagctagcaatggggaaatggtccaggctcctgcctcaaagcaaccatctcaaattttggattaaaaaacaaaggcttaaaaaggggagcttggaatgcagggcatgaaggaggggtgaggaggtgctgctatacaggacttgttccaaagacttgagttattatccagttcggtaagtgggctggcgcatcccgcacaatcgggttgtaaattaactgcagccttgaggtgatctcctgatgagggagaattctgaaggtgcctaagtcagtcagtggaacttctaagcaagcattaataattttaataataattataagcgtaattagataatggaagcgctgtgcagggagtgcctggtgggaagaaagagagcaaaggttaccatttcattactaaaactggaaggaaaagaaaggaagaaagatctttaaaatagagtactcggttacatcaagatgccatgatttaacaagagactataatacataagtaacttgtttcctcagaaaaagtacttaatattcatggtattgtagtacatggactaattcgtacacgcagatttcaatttatgtgtgttataagacccggtttcaactttagacatgaagggtcacttttagacattaggaacccctctttctcctctcccagaaggcataatggtaggttagaggtgctcaccttttgactaggaagtagagaaagagcctcctataaagaaatgcattgtccagccactgcaggccttacttacagtgtcttatgttttgtttttatttcagttgtaatatcagacgagtttagttttaaaatgtggttttagtactcatatttgaatttggattccatccagaaatagatttatccagtgttaggttagggatgatatatgccatttatgcttatgattgctggaagaagaggcacaatttcagttgtaacttagatattttataattagcatttgtgtacattatcctgaaaaaaaaaaaccctcatctcaaaactgatgaagccagttatcttttttaaagatgataaattatagatgaaggattaggtattttaaaaaagactgcatcctaaactataaagttttttaatggcctccataaaatattcagaataattcacattatgtataacttttgaaggatgtggtttgtactgctgcaacataaacgtttcttttgctgttgtgaaaaaagcatttttctctaaaaacactgtaagtacagcaagtgggttgacagactaggaaaaagctctagctattccactatagtgttgacataggtacgcatgttgagttgcattgtaccgagcattttcacagatcatttaatttttcttcagaacactttgtgggcattttcctcattccttttgtacatacgagaaaaaatgaggcttcaagagcttagtgacttgtcccaagccatcgaacatggcaggaccaggctttgaaacccaaaatgacgttttggccgcactccacaccaaatggctaagcattggttctgacattgttttgccggttagtgaaatcacatttgcgattcagaagcacattttaagaatacagaaaacagtgaaaagaggatgaagaatgttaacattttttcctaaatgccatgaatagagcacgcatcagtaaattaaatgtctttcccattcttttataaaacagtgattatttttctcttgtttcattttagcatttataagaattctatttttccatttttaataactgatggaaacaagcatcattgtctgataaatttattttcatgctgtacacgtaactaccactttcatcatccactgttccaaacagatactgaaagtctcttttgtaattttctccttcccagtaattttctccatctacttgcagtgtatttgggatcctgacacctttccattctaggaggatgaagtgctttgggcagctatattttcttgtctgcctacagagactattcaatcacagcaagtgaagggttttgcagtgctagtacaaacagacaaggaaaaaaacatataatttctagttatttatagcctgtgcagctatgtggtcttatttatagcaaactgcacatttgatttgaaaaagtcatggtcatctggaggtcaaattcagatggcagactcaattcagagaaaaggagctgaactagaaggtaagcaagcctgttagactgggcaacttggacttgactttgctccttcaacaatctagagccagttggatgatatttctgcacaaaggtggttggttttacaggttgctcagtctaagctgcttctagtcaaataacaaatgtgaaaggagatagaaaaagctcttcagttgaactgataaaagattacacttagggagaaaatgtatgatggtttgcattataaaaacaataatttgccataaatcaggcatttctaggtttcaaacttttgtcataaaaaccaattttgagcattgcaattttagggacatattttattgttgttattttaaataaaaatctaaaccacaaatataaggctgagagctttcattttattcgtgaacataggaattcaaatcattaaaaaaaaaccctttctcatttgggataaagaatcttacgagagctgagttaatttctgacattagttttgcacctgcccatttgggtttaggacagtgcaaaaggtttcacatttaatcttcaaaatatagtatttgtagacaataaaattatataaatatttgtggattcatttatattttaaatatgagagtgtgaccattttttcctggtgctgtctccatcagactgcatcccaaaaggcaaacagaccaactccttaatggcatttaatctctcaaagagcatcatgccaatttttagtcagcagattgcaccatgtgatctggccaaagtgtgtcccatctcaggctccttcatttgcgctgacatgtggtacaaacaactaaaccaaggtttctcaacctcagcactattaacattttgattcaaataattaatttttaggagtctgtcctaggcatatgggtgtttagcagtacccctgacccctacccactaaatgccattaacacaactccagctgtgataactaaaaatgtctctagacattgctaaatgtgcccagggggtcacattctggttgagaatcctgttctagagtagtagtttccccacatctgactcagagatagaactctcctggtgtaaacacgtgtactttccacaaatttgggggcatgttgaaatgttagaatgtcagcatcatccaattctcgacagatgtttgaaattgaatttgttagactattgtccaagctctcaatatttgcaaggtaaagtggaagttgctgttgctgtcctgactatagtattgaaggtctcgtagttttcctgctctaatgtaagctactgtggcagcagaagagaaaccagcaaatcccttagtttgaagtcattggttcacctatgcaccacccctttctcctctctgtttcatcttagtttcctagaatcccaggatatgctggaggacaaccatctgtagagatgtcctatagtcttgctacacaggttatttgtactttaggattatgtttgatggccttatagtttgtgcagaggtgtaggcctgaccccatgcaggattgagggagggaaaaagattgatttctaggcacatcagaatggtccagatgacatgaaacagactggtacacttacagagaatatgaaaagaattggaacttaacaagtcaggccccaagttccatccccaggttccaagtttgttgccgcagaagctcataattttcaaatcgtagaaaactcacaccacgcagcctttcaatggaatatgccaccttaaccccagggtcgttgtaaagacaggagccataagacagaagtctgaatgcctaggccatttaatctttggccaaatttgaactattgttcttaatcacactattcttgttcttttcactgtgcagtagcaaatgttagttcccattagcacattctgcaataccattggaactaaaactgccaaattagattaggcaacctgggattacactttgctccccaaccaacctagggagggagaacaattttaaagcattaaaagatgtgatggtgaattaaactacctgtcacgtcagtgccagtatattctatcagattaacaagtgtgaaaagctaaatctttggtatctggaaatgcttagataggaagaatggctttttcttcaaagccataataattagagatgaccctaaaattgaaaggaactggattgcttagcaactcagcattttttaaaaagaagggccatctactttgaatacaggttaaatatctcttctctaaaatgggaccagaagtgcttcagattttggatttcggaatattgatgtattcatgatgaaataacatgaaattcatttatgtttcatgtacaccttatacaaaagtctgaagataattttatacaatttttttttttttttgagatggagtctcgctctgttgcccaggctggagtgcagtggcgtgatctcggctcactgcaacctctgcctcctgggttcaagagatccccctgtctcagcctcccaagtagctggaatgaatgacaggcgcctgccaccacacacagctaatttttgtgttttttagtagagatagggtttcaccatgttggccaggctggtcttgaactcctgacctgaagtgatccaccagcttcggcctcccgaagtacttcgattacacgtgtgagccaccacgcttggcctatacagtatttttgataattttgttcatgaaacaaagtttctgtacgttgcactgtgagagaacaaaggtgttgctatcccagccaccatgatgtcatgtcagtgctcaaaaattatcagattttggagcatttcagattctcagattagagatgttctacctgtggtaaaagaatgttcattatgtctctgctctgttgtttagctatttgccaaaagagggtaagtggatcgtttaataaagtggtcagcaaatatttttcatacaaggccagattatagatattttaggctttgtagatcatgcagtttgtcataactacttaactatgcagtggtagcatgaaagcaacaatagacaataagtaaacaaatagacaaggctgtgttccgataatactacttttataaaagtagccagcagctgggtgcagtggctcacgcctgtaatcccagcactttgggaggccgaggcgggcagatcacctgaggtcaggaattcgagaccagcctggccaacatggcgaaaccccatctctgctaaaaacacaaaaactagctgggcgtggtgatgggcgcctgtaatcccacctactcaggaggctgaggcaggagaatcacttgaacccgggaggcagaggttgcagtgagctgagatcacaccatcgcactccagcctgggggacaagagcgagacttcatctcaagggggaaaaaaaaggtagccagcaagctgatccttggtttaatacagcaggtttttttatttttatttttattttttttccaatagctttggggatacaagtggtttttagttacggggatgaagtgtatagtggtgatgtctgagagtttagtgtccccatttcactgagtagtgtacattgtacccaatacgtagttttttatccctctcctccttcccactcttcctcattctgagtctccaatgtccattatgccactctatgcctttgcataatcatagcttagctcccaatttataagggaatacatactgtatttccattcctgattacttcacttagaataatggcctccacctccatccaagttgctgcaaaagacttttattttgtggtttttctggcctactagtattccgtggtatatatacaccacattttctttatccctcattggttgatgggcacttaggttggttccgtatctttgcagttgtgaactgtgcagcagttatttttgaccccaggatgtgcgaggccaggtattttgagagacaccagcaaaggaatctgagtactggctatcaatacctgataattttattaatgagttgagacccagatatgccgtagaggtaaataaccatataaaggaaatatagaagtgtaggagaagattgctctggaaggctggggtaaaatgaaatcagctttatccttaagacctccatagaggttaactgtaccatctccttttactgctacagtttatatgaaactggacaatattgaagattttgacttttcgaactcatctattgagtgttgagcagctatgacaggttatttctttatgtgcctccattaacgaagtcaagaatagcttctgacaaattgacaaaaaacaataacctaaggttaacccattctggacgccagttattgctattgcttcacatatattttttagattcaaacttgaggttgcttttaagttttagtgtgatgtgctgaatagagaatagatgttaataaaaaaataatgccagcattcgttccttcacattcagttcatatatttgaaaaaattcccatgtcagtatgtgtccatggacataaaaaagaaatgtagcttgactagagtaaacacatcatagattatatttttattaccttatgtccatgtgatgcattgatagtgttctccaccaactatgattgcactgactataaaattgtaatacaagggcatattagggggagaatgcctttgttttttcttttgttgttattttgtttttaagagagtctggtattacactggaggatcacaaactgtattttcttgttataaatggctcctctatcttggacttaatggttaggataaatatttgaatgtagaatgcgttaggagttttaactatttttgaaattaggaaaatggagagacactttttttttttttagagacactttttttttaagttataataagcatggcactcggaaagctctgccatgtttcaagattaaagtttcacatgaacgctaacaagtttatatttcactcatatataaatgatcctccttgtctcctttcctaaattatagccatctcaaatgacaacattgctgggtcggtatcaaatagcattttcaatgataaggcaatgatttatataggtcttaatttgttttaatcttctgttaccaaggctgtagagataaattgcttttctgctgatgaaaggagactaacccaattttcttgttagaatctaatattaatatatcgactgaatgccattcataagccttggtttagggaaacattcagccttctggcctgttggagatggccacggtcattgctgtttgaaggtgggtcatttcttcttttgtgtcctgagtccattgtgactgtaaaattatgggtcaccccagaagcctgaggaaacaaatgcatatcaaaatgataggggcaatctttcacagtgcctttaattttgaccccacattcttatatgaatgtgaagtaccacattagtatgaatatgaaatggagtgctccgcaatgattacaaaatcagaactaaaatgagggaaatcagtgcatgtacagttcaacttaatggattatcctctaaggagtcttcagacaggctaggagagtgacgtctgcctcatcctgaagatattagcaggttttcccctgttttaaagtaacttcccttcaaatgctaacagttttctcagaggaaacacaggtatggaaaatgtttcgttggtgtcttggccccagtgatggaggagcattttgtgataggaacgttgggtgcagcatcgccatttatgaataaactgaaagctaacctgtgttacttcaccccagaaaacagagctctggcaggtattgagaatagatcacagtgtgaagtggcagtattgtgacaagcatgcgtgtatcagtattaaaattgaaatgagccctcacgcacatgtgaaagcagtttctcccgttttcatattcagttccctgaggtaatacagcattttggtgtgagagaaagaagggaatctgacccttctcgtgtgggaagggggctgagggcaacaacctcctgtgacagccaccctggtccaagccaccttcatctttgtctcctttttttttttttttttttttgagacagagtttcgctgttatcacccaggctggggtgcaatggcacaatcttggctcaccacaacttccgcctcccgggttcaagcaattctcctgcctcagcctcccgagtagctgggattacaggcgcctgccaccacgcccagctaattttagtatttttagtagagacagagtttctccatgttggtcaggctggtctcaaactcctgacctcaggtgatctgcccgcctcagactcccaaagtgctgggattacaggcgtgagccactgcacccagcctgtcttttcctcttaaaagatcttccttctacttttgtcccatagcagccagagtgatccttcaacaaaacgccccatcacatatactccccctcaaacagcccacgctggtccctcagaatccttactgtggctttaaggctgtacatgatgtcccccatttcttccctgcctctcccactacttcctctcttgcttctttagctctggccatgcgggtctcgtggaatttgccagccagcttcaactcttagggcttccgtgctagttttgtcatctgcctgccatgtccttccagcagccagctgggaagatctgaatgtcacctcctcacttaagactctgcctggtcgctcacttactgcggtctacctttcccctctcccctcagctctcccgatccttctgaactctgctctgtttttctttttcctctttttctccataatacaaatcacatattaacaatatgacttactggcttttaaaaaattcttgtggtaattgtttctttccctagaatataattccaccaggatcagggccttcatgtttttctcattggtttctcccatgtgcctcacatataataagggctgcaatgttggtgggctggaggaataaaagaatgaacaggcgcactaaaggcaggatagtttgtccatgtcagagctgctgtctcagctgctttgatacctctgacttcccagggtggcaaagaataaggatgtggcttatgtagaaggcgttagtcatccaaaatgccactgtatatttggaagcaaatattcaccttgaagcagtgatgtactaggaattagaactgcttttctgttacattttttcatttgttatgagtgtttagatacacatgatcactattaaaaggaagggaggtaatagcctatatatcctaccatgcccctcaaggctctgttaggagactaaaatacaaaggtcatttaaaaagttaaaagcttatgcatgtgatgttggtattgctgctaatgactaggcatctagaggtcaaaacctagagctaaggatattgaaccctgtgttttgtctcgttttaagtctaggtttttgtggaggggggaacatacctagccagcttgcttgcagaaggcatgagtgagcaggctgaaggagggacccaaggccagaacgtcctccatattctagctccatgggctctttcacttgatccctgctttatgacccaacttctgttgaaggatttgccagatagtgtttggggcaggaacagctgtttcatagaaaacaagccaacggacatcataacaaagcatatggttgttttgccaagttgtgctgctcattaacaaaacaaaacaacaaaaaccctttacagtgccccagcatgtggatggattggccctttactactctaaaaattagctttacagcctttttatggcttacccaatcttaacagactttatttgtgtgtgtttagggatgcaaatgggtatgttaaatgatagtgttttgcctctacgcaataaaatagggtaattttttcttcccatgtattaaacgagaacacagaacatgcctagcatggtgggctctgatgaaaagaggctgttatcatttggccaacatggaaatcctagcctttatttatttatttatttgagacggagtgccaacatggaaatcctagcctttatttatttgtttgtttgtttgtttgagacggagtttcgctcttgtagcccagactggggtgcactggcatgatctcggctcaccgcaacctccgcctcccaggttcaagcgattctcctgcctcagcctcccaagtagctgggattacaggcatgcgccaccacaccctgctaatttttttattttattttattttagtagagacggggtttctccatgttgatcaggctggtctcaaacttccgtccacctcggcctcccaaagtgctgggattacaggtgtgagccaccccatccggccgaaatcctagcctttatcagaggttccgtggaatctcagaggtctgtgagcaggataaactgctttatggtagtttaaaatgcaaaaccagaaataaaccctcctaaagccagtttgtttccactttctaagtggttacagtgacctgtgttttaagtaccttaaatatatcagtgacctgctgatatacagcttcctgtttcctctgtgtcctgtgacatatcctgacattccttgagccccactcccttcccaaaaggaagtaccttgatgggtgaggacatagggcacacgtgtctctggccttctgtggacataatcacaaaatggtagtcagtcctatgaatttaatctctttaggatataaggatattcacgaaatagaagttgagctctctggacatactccaccttaaaattgctctctccttccgggatcctcaccagctgcagagcagtagtaatgaactattaaattcatttaacaatatcagcatatgctatccttctctgcttgactagacagtaatctggcttgctggttggtatgaatataggataatttcactcacactaattgagatggggagtttgtatgaatggctgaaaaatttgagttaaagataaaaagagacacagcttcctcaactatgggaaataactgggactgttaacaaagatttacttgaagagaaattgtattgctcagggttctccagagaaacaggaccaataggatatatatgtataggaagagattgattctgcagaattgactcacacaacaattatggaggctaagtcccacaatctgttgtctgcaagttggagacccaggagagctggtggtatgatttagtccaaatctaaaggcctgagaaccagggaagacaatggtgtaaatttcagtccagggagaagagaagaccaatatcctgactcaggcagccaggaaataaaaagggtgaactgctccatcctctgcccttttgttttcagaccctcagcagatcgggtgattcctgcccatgttgaggagggtgatttactttactgagtgcaccaattccgatgctaatctcatccagaagcaccctcacaaagacactcagaaacaatgtttaatctgggcaccttgcggcccaatcaagttggcacagaaaattaattaccacagaaatatttctggattcaatggattaagttggtaatatagtattcatattcatttccacgtgcctaaaaagaaggtttttatcctttttaatatcctcagtcctattaaacatacctcacattcatgttccatggttattctcttattatgttgctaagtgcatttctacttaggccaatctgattatagtgattcagattatagtgtttatcttctttcctttatacagtagacagtgttcgcaaaccataggagctgaaaaaatttccttcttatatagtaagttttatgattccagttttccaaaggggtgcttatgttatggttataacagttacagccagatgactatcttcatcagcaggtataaccccaaatatttatacattttcatttgtttcaaacataaaatatggtttgcctaaacatgtcattctgccagattggactatgcaaaagaatgttactgttttattttctgcttttactttaacttgttctcatttgagctctaccagttaagatgagaagatgactaaagctagggaagcacattttaaatgctaaataccatgttcatttcaagttgggaacttgaaatgcaagtatttttaacttaatcattaagttaaagtcagtaagaacgtggtatttagcatttattcattttaacttaatgattaagttaaaaatacttgcatattggtttgcttgaagctatggagaaaaacatttaccttttttccaaaaaggtcttaatattcaaaattattgtttcaatcttacaaattaacaatttacttatttttgatactttcggccttttttatgtgggctacacctaacattttttgaaaaatacatactgcttttcctgtaggttgcactttgtgatcctgtgtgtaattcattttcagtggttctattttatttattttttgttagtttgtattttcttttgtttctttttctcaatttttaaaattttaaaacttgtccttttcttttttttctttattattgcactcttctaccaaaacattttcagtggctttgaataaaagtatcagaactttcccgtggttagcattagctctgagatttgaacaggatgtattaagcagaggaggagggaaggccactaacatgtatgagctccactgtgtgtcaccctctctgccggatgacttacatgtggtatggtatctcattttcccagctctcctatcatgtcctgcggcatgttatcaccacttgataaaaaaattgaaacatggagtgcttaagtttcctgccccaggtcacagctgatctgaaaaagaaatgggattcaaatccaaatgtgcttaattgcaaatccccacatgactctttccttccttccttccttcccccgttgctgccaatgtaagaaggaacaccactccctcatttgctacagagaagacaggggcagctgtgtaaaggcaccaggaatatgccctgcctccttccttccacttgaaagcaacatctggatagacactcaactgcttttattttttgaaaaatgattattaatcaggattgaagtggagggaaaaaatcaaaacgaatgtttctttttaaaatgaaagatactgtttaattatttaacagccttccggttttagttaatatctttgaagactttggattaagattccagacattttcttgaaggatgtagaaaacgtatttaacttcaagtttagtttcaaaatgacttagctatcaattcttctcattgaagtcctctttgagatattatatcccaaatgtaatacacaggtaataattcaataggaatacttggaacattggtgatatttgaataaccttttgaatgaaacaattgatttgatctcaaaagatagtgaaaacgtctcattttgttttttatgttaaatatgcttcctcttaagtcaaaattcttttttctttttgcttttaagctcataaatactctgaattctcactaatcttttggaaaattgcttgtataggtattataattcacttggctcatgagttacataatatagcagtatatgttgcaattcaaatattgcttagcagtattagttgaattcaaaatagaaatcactttctttttgacaactagcataatgaattcattgactattgtcaaatttatgaagacagaaaagtccttttgtgattcaaaaatgtgtttattgatgtttatatatcttttgtcgtgtttccatactgtctcatgaaggttgtcttcgtaattcagttatctaaatacatcatacaatttaccttttccctggggtgccgttattctacaacaggctaattacagatatctgtggtttctgcaggagtcttagtgtatgatattgatgatatcatcatttactttcaaaattgcaaaatagtaatttaggaaagcatggggatttggaaaaacatgtcttcagcaccaactgtttttgctctttgcatgcttgtttcgtaaagaactctaatgctataattgcaaaatggaccattttaaagatttttccttcattctgtacttgggagtggtgaaagacatccttactgtgctgcacagtgtctcatggtgttctcttaaacagcattaacgtcttgtatgcgctgctttactaaattctctgttctgagaaataactgaaaatacggctttctattaaacgagtggattattctgttgttgttggcttttttttctcaaacctccttctcttctactttatagttcctacaacagcagccagtacccctgatgccgttgacaagtatctcgagacacctggggatgagaatgaacatgcccatttccagaaagccaaagagaggcttgaggccaagcaccgagagagaatgtcccaggtaagtctggctcttccatcattcagccctacgatattgggaaacctgagcttgcctctgcctcagtctccccacaggcctgctggctttatcaagatctttaaagatgtaaagttctaattttaaatgtttactgtgtgggcacagtttgtgggttttttgcatcctccgtgaacatgctgcctaggaaggatccaggtatagttggattttgtaagcacaaattaaatgatgtctgtaacattctctctggcgaagaaaggtacttggcattattattctgtgtatatgtagtacctgtaatcaacatgttgtaaattaaaatccatcaaaatgctctttagtaaagatgaggttttgtattaaatcccagactgttataattgtgaacctacgattgtttacagtctgtaaaatcatagagacttaaaactgagctgaaccatagtgattatttcatctagtctcctaagtgatacatagtggaatagaggttcgagagagtggcttcccattttagcacaaagcaaaatcagtgagccagagacaacatttagaatccaggcctttcttgctcctagtacagtactcctttcattatactttgctgaaaaaaaaaaaaaaaaaaaaaacctgttttggtttggtttgtttttttttagcaggtccttaattaagcaaattaaaaaataacttatgtctaaaacatggctaatccatatatactatcaactacaattgaagctatgtctgctaccaggcactggatgttgtattggagtttgataatatggaggattttagcccttgctcagattcctcattcattcattcattcaatcaacaaatatggacttattattttccagtcacttttctgatttgtagtctacaaacctaggagtgaatgtggggggaaaagaagtaggacataaaagtgaatgaataaagatctcaggttaaagtaagccattcatttttagtgttaatattctgtggcaaatatcagaagataggagaaatttttgtcttagcacagatgcttaatctcttgagagacattaaatgcaatttatgaattagactgctgcgtattttctaagatcacagtcagtctttagtagacaattaatctttcctgtaatttctgatctgggtccctgctgaccccaggaagattcctccctcccagggccaaatgaatggcccctgagcatgtctttcccatgcaaaccagtcaatcaaaagctccttactcccaaccaccttcttatactctgggccactattcacctgctctaatcaccccaggaccaggtaccagaccactagggacaacctcatgccccatcaccattatttgaactaatcagtcctaaacccgcctaccctgcttcgctcattctttccatgaaaaccacaataaaaggctcttgctcatgttttcccctcctgaccaaccctggtgcttcccatatgaccctgcatgtagtggcatgtaccggcttcttgggagctgagtaacaaactgtcttttccatgataatcatctcctgacctcttggcctcacctgaataataagaaaatctacccttgaaaacataaaactaatagtttatctagaaaggtacaacacaggtactgttttttgtttgtttgttttgttttttgtttgtttgttttgccttaagatgaataacaatacttggatctactttggtataataacataaagaggaaaaaagccttataatcacagtacttttggctctggaatataatgtgcagttctagtggctgcccacgatgaaaacctaacagctaattgaactagaaagctagccacagggaattattaagttttcacctgatgccaagaaaatcagatctttccttaggaaagacacaggcactgttcggaaagcattggaggactatgaatcatacttattgccactgaaatgtcctcatttgaatttacatcctatctcccttctttatgaagctttcagaggcttcctgtgccctcacaaatccacttctgggcacatgaagtcgtaaaaaaagaacaatgacaaaaataaacaccgaatgctcagcttgtcattttcagcgcctaccactgtaccctgactctggtcttcctaccacctcttccttctcaactgctacccttgctttctgtacagcgttaagctgctgttctgatcaggccactctgctcatcgtctgttcatctcatcttgggcttccctttgcccttggcattgagttcttctggaaatgccctcccactcttcttcacgctgacacatctcacccattccttacaccccacttcatactcagaatgagacaggcagtcattgctcttacctttcatttaattctaaatatttgctccccggttttgttagtgatttctggacacacctgcattatctttccagctggatagtaaaatccttgtagtacctctaagttcatgtaagtcttgctaaccttgcatttcattcttggacccacttagtcattttttttttaattttgtgtttttttaatcctggattttttctcctagtatatcttgttcatttttgaccttattaagaaaacttatttcaaattctctgttagttttagatgtgacaggtcttctttaaaataataatttaacttttagcacatctgtgtaacttgtgacttagttcatgattttgtagattttgttcatcttttagtcatcagatatatctgatataacctaagagatgttgtcccagagcagagaatgttgtctactagattccagtggtcataggaatgtgagacacctgaaatcaatatgtatcttcatagtctgtggtgctgaaatctagggacttttcaactttaaacttgcctgcctcttaaatctctacttagtagtagtcattttctctgcatgaaacagccaagtctttgaagattgataaatccaaatgaaattgatacctttgtgcctgcagtggaaaattgctttataagaatccatagagccactgcaagggccaggtcctgagaattttaaattttaaaaattgtgcggttttttaaattaagttttattgtagtttttgttatatgttttcttacaaatacagaggattttggaattttttcatattttggtttgttgttgccattgtggagtataactctaaacctgtagatttttgttgctaaacctgtagatttttgttgctatatgtcgtgactagcatctagtcaatagaaatctacagctgaaccatgtgtgagcacttttattacttataaacttactacttttagtatatgcttaaaatgaagtccttcaaattgaaagctgacccaactcataggtttttatttcttatcttttttggagatggagtcttgctctgtcacccagctggagtgcagtggcacaatctagactcactgcaacctccaactccctggttcaagcgattctcctgcctcagcctccccagtaactgggattacaggcacgtgccaccacgccgagctaatttttgtatttttagtagagacagggtttcaccatgttggccaggatggtctcgatctcctgaccttgtgatccacccgcctgggcctcccaaagtgctgggattataggcatgagccactgtgcctggcctaggtttttatttttaagataagcagcaacattttaagagcgcccctttctcctgtcactaaatataaataaacttagctcacctaatgaattttttattttataataaaaaattgggtaccacagggtacaaaaacatgatctttagagccacagagatcttggtttatattcttccctctcccttttttacctgcatagcctcgagctggtaccttaacctggttcgtaaaatgggatggccctggctaatctcacaagctgttgtgaggaatcaattaaattagatagattttgtaaagctcttaatacagggtcagcagtaatgctacttgttatcagtcccacagtgaaattcactgttcacagggagatggtcagcctacatatagtgtgtattcatttgcagtagagtcttagtgggatggtgcaggtgatttgtttatttgtgggggtataggatattgttaaattgttctgaaaatcaaaatgtgagttaatttctatagtaatgcttatttgcaactcattagctaaataaatctctttaattatttcatggattcccccagcttaaagcttaaagtccagtttcttaaagtgtatgaggtaaaatggaaaaaatgtaaatgtaatatgggaaatcagttctcacattgcagtagaacattgaacttctatctcaaactaattttgagattccttgcttgaagaattgttggtagagtaccaccactgtgaacattcccaaagcaggaaattgaaatatttatattgcaaggcttatctcatctataaagcaaagatggtcttccatttcccccttgcccacaggttccctttattaacgtggtagaagcaccaaagcagatgggacaatatgtttcttttcttccatgttctattcttgttcattgcagcagggcatttgtcccaattttgctgtgaaccttgagattatttttgatatgcttttcaagtgtaatgaaatatttattccatcttgtttcctccatggttttacaaaaacaacaagaagaagctaattgcctatcatatacaaagaatgaatgccaatggacaataaaatctgtaattaggaacccacatggtgatttgatatagtattgtctcatagaagtcttctatctatagttatttattccaagcctctttttctttcccatcttgaagtatgttagaagagtctattccttaaggctaagtacctacaaaaaacaggctcttataatacagtaatcaagttttctcatgctttgggagtacacagagtatgcaagtacacatctggcaccaaaccaatattttgtttccttgatctttcttcattttacctagttcagagttgcacttcaaacaaattctacttgtcatacacttgaaaaggcagctgtaggtggtaggaagttaatattttctttgaacaacatacagaggtgcagacttttactttttgtatcaggttaatgagtgaacttctctcagggaaatccaggtgaacatcaaagttgagagcaggaagcattgatttcctacaaaacacattcacctgatatcttagtcagtttgtgttgctataatagaataccccagcctggataatctgtaaagaaaaagaagtttaaaattcggctctcagttttgcaggtggggaagtccaagaacatggtgctggcatctgttgaggacttccttgctgtatcatatatggtggaaggaagaagggcaagaggagggcaaaactgagttttataacaacccacttctcacaataacaaacccactccccccataatgatactaatttactcatgaggacagagactgaatcacctcttacaggacttacccctcaacattgttgcactggggattaagtttccaacacatgctttttaggggttacattcaaaccatagcagttggttactaaattagtgctacttgtaaaaaaatacatgtttgctgcattcagaatattacatgttttcttggagtttttggaaggacttagcgtaatccttgctgttcatgacttaggttggcaagctcaaagggccttaattccccatcagttctttaaagggggataggtcttaggatattagacagcagaagtcttctttttcttcccccattatgtactgctttttggcattgtattcatgacacacacacacataaaatgtcatattttctttaaagtcaaaatatacagtttaaaatggtttcagttgctttcataagagagtaaaacttaggtgttcagtttaatattggaagaccttgttcagttaatgtgtgccttccatgaatagttggtatttgttcacatcaaatcaaatgactgtcagttctcggggtaaaaaaagaccaaccttgactcaaaaagctatattcctgcaataaatatgaacatttatgtttaatatactgctgtgattaattatttatatcctagtgggaggtcaaatattcttcagataggaaggggtatgtaataaattttttaaatatctaaaatgacaaaaatagaggaaaaacataatcatccatcctattaagtctgtattcaaaggatgaactgatgattttaaattcaaatgtttccttaatttataggtcatgagagaatgggaagaggcagaacgtcaagcaaagaacttgcctaaagctgataagaaggcagttatccaggtaaaacctgaacccatttcctaccaaacatcacatgccagcagtctttttaatgagtgtctgcaggtttacctttatctgccagcacctcacgtgtgattgttcatagtcccatgaacttcagctgttcttaatcattgtctagtaattgagttgtttaaatcctgccttatatttgctcccaattatttcaagttataattcattgccataaaactcacattgtaacttgcaatctactttttattaataatacatcttttcagtcaccacaatcttctgctgcttctccctccagcaaaaattatgagaatttgaatttttgatggaaaccagtctcaaaattaccttaagtaaaccaacagtttattatggtcaattacttgaggtactgttagtaagagagggatttttttttaatatgtaatataagagtttcaagagtgcatatatttatccaaagttattagtcaaatcagccttcagagagcctatgaaatactgattttcaatgagaaagtaggtttgatgagggttggagagtgcaagaaagtgaagtaagctataaaacgtagaattagtcaatgttggaatgactatgcagtctttaggatactttttagcactagaagaaaatggaataggatgtcttttttagaagacttgaaattgctgcttcatcctacttattcagtccccatggacatatgtgtttatgatggcagcatttccaggagaaagtggaatctttggaacaggaagcagccaacgagagacagcagctggtggagacacacatggccagagtggaagccatgctcaatgaccgccgccgcctggccctggagaactacatcaccgctctgcaggctgttcctcctcgggtaggtctcgctgcagccgagttcacacttcaggtcacagcacagacagtaagggtggggcactgggaactggaagccatacaaaaagaatgaggagaaatgccttgagcactgttattcagaggttcaacccctgtccattccatcttgaaggtcaaagggtcacagggcagctacctccacaaggtcatctctacacagcaggtactcacacttccccacagagcagccagacaggactcccagggactcacattgcaagccctgacttgatttaatattcctgaggtggtgacaattgatggcatagttcaagttcgaacacaaaagctggaaggatgtcttccagtcccttcaggctgctgtaacagaataccatagactgggtaccttatcagcaacagaagtttatttctcacagttgcagaggctgagaagtccaagatcaagacatcagcatacttggttgtctggtgaaagtttgcttcctggttcatagaacttaaattttgtttatcttttatttattttatttttgtttttgtttgtattttgctgtatcctcatatggtggaatgggcaagagagctctctgggccctcttttataagggtactaatgtcaatcttgaaggctctgccctcatgcctaattgtctcccaaagctttcaccctcaaatagcatcacactgtggcttaggtttcaacatatgaattgggggtgggagagacacaaacattcagaccatggcaaaggattttagaagtaaccttgcccagccccctcatcatgtaagtataataatataactaaggtcaaggaaagttgagatttggctgagttgtaagaatttttagtggaccagaaagaattagaactcaaatttccatctcagagcagtggccatattctctgtggggaagcatttgtcagtcatgacattagcaatgatgagacttattcatggttttcagtgatcattgccccaaaaaggcatgttgagtggtacaggcatagatgtgttcaccggcattctgtgggagagcttacttggaatggaaggaactttctgagcatgagtgtgtaacttatgtccacttgttctttttttttttttttttttttaaatgagatggagtctcactctgtcacccaggctggagtgcagtggtgcaatctcagctcactgcaacttctgtctcctgggtttaagcaattctcatgcctcagcctcccaagtacctaggattacaggtgagccacgacacccagctaatttttgtattttagtagagacagggtttcaacatgttggccaggctgatctcgaactcctgacctcaggtgatccacccacctcggcctcccacagtgctgggattacaggcgtgaaccaccatgcccagccatttgttctttctgtttgtcattgagcaagggatattgaaagctctgcctgtgattgtggaccgggccatttttctaaacagtgctatcagtttttattttgtatagtttgaggctgtgtttttaggcgtgtaaatgttccaggctgttaggccctccttgagcctcttcttatgaaatgatctttttatcctttgtaatgttttgctccaaaatctactttaatattaataaagctattccagctttcttttgattaatattaatgtggtgcatttttccatccttatactcttattgaccttgtttgtctttatatttgaagtgtattttttgtaggcagcatgtaattgggtcttgcgttttcctttggattgggaagaccatgtacactgaatgaggttatggatatggttgtcactgaatctgtcatcttgatatttgtttgctatttgtccagtctgttccttgttcttcttttttcctcttttttttttggattaattagaaattttttatgattctattttatctcttttgttggtttgtaagttacaactagtttgttattttactggtttatctcctttgtgggtttataagttataactagtttgttattttactggttgctttaggcttatagaaaacattctaaacttgtcacgatgatgttatgtcagttcaaatgatattataccactccacagacagtactttacaaaagtacttccatttttcatctctctctctctctgtaagcggttgttgtcatactttttccttactacattgttgatgtttttctttaaacagttattttttaatgagttgtaaatttaaaaaaaaaacaacatgtttacccatgaagtcatcattttgggtgctgtaaactctttgcgcagatccagctggtatcattttccttctgcctgagagatttcctttaaaatgtcttagagactgggcttggtggcttgtacctgcaatcccagcaactcaggaggttgagataggaagatcacttgaacccaggagttcgagactgcagtgagctgtgattgcatgactgtactcccatctgggtgacaaagggcatcctgtctctttaaaaaaaaaagtttgagtgcacataagttggtgatgaaatcttttgtttggctttgactaaaaatgtcttttttatacctttggttttgaaaaatatttttgctgggtataaaatactggattgaggtttttctttcactgcttgaaagatgatactctgctgtcttatttgtgttgatatctttatctttatttctctaaaaataacatgtcttttttttctgtttttacagttttctctatatcactggtttttaacaatttaattttgatatgccatggtatcattcagtctgcccttaattccatctggccgtttttcatcttatcacctcacatactgtagttgttgtatatagaaatttaacctgggctacccccaacacccataatatcgtctgtatcttaacttttgaacctatggaatacagttattatatgaaaactgtttaaatatccatgtttgctaattctaacatctctgtcaactttgaatcaattttgattgcttattattacatgtggcatttccctgtatcattttatgcctcataattttttattaaatgtcggacgctgaatttaaacctgttgaatgctaggtgtttttgtaatattcttgagcttttttctgtcacatagttgagttacttggaaacagtttgatccttttgagctttgcatttttagatttgttaggtgggatagaagcagttatcagcctaggactagttattccttactagtgaggcaagacccttctcagtcatctaccatgaatgttaagttttctcacctgactcgtgggaagaggcattattcctgtccctgtgtgaacaccaagcactgttaatgctaattctttttggtgattttccccctggcttcagtttctttcacatgcatgtacccatcattactcagctatattctcagggatcactctgcacatctctggattctcttttggagcaactctctcctcaccaataccctgtcctgtgaattacaactaccttgatctctccacacacttcatgtcctccactccacgagtcctctaggctctgtgtgggtttccccacctgaaaccatgacctggaaattcagggccatgagtttggcagctgtaagtcctcatttgtttccccttttcaggaatcagtgtccttcacctgatgtctaatgtcttgcagaaatgttgtttatgccaggtgtggtggctcacgcctgtaatcccagcactttgggaggccaaggcgggcggatcacgaggtcaagagatcaagaccatcctggccaacatggtgaaaccccgtctctactaaaaatacaaaaaattagccaggtgtggtggcgcacacctgtagtcccagctactcaggaggctgaggcaggagaatcacctgaacctgggaggcagaggttgcagtgagccgagattgtgccactgcactccagtgtggtgacagagcaagactccatctcaaaaaaaaaaaagaaacgctgtttgtatatgaatatattgtccagttattggtggttcaggcaggagggtaaatccagttcttctcactcaatcttggctggaattgtttgtgcattttatgcaacttaaccagaaagtcacccatttgcaccgattttcctcaccattttgatttttctttctatggataaagttacagtgcacagaaagccatgaggagccgttaaagagctcgtggcattcttccaagacgtaagatactatttaccctgttctaccgatgatatcactgcaacctcgggagatggagcggctggttcagggtgacactgctgggaagggagagggtagagccgcgagtcactgtggtgccttctcactagaacgagcttcctctctaaacaaagagcttttgaaaaagaatattcatattagcgttttcattttctatttgccaaaattctctatcttagcaaggcacttgtcaggaaatttttttttatatctctgcagaacaaaagttccttggttcctctcttttttggagaacacgctttcaggagaggagccgtgtgatcatttgccagagaaggataggctggtgggtgctgagaccagaatctttatagcagaaacttgtgaagcgttccagctgaaagtccaatctctaaagtaagatctttgctaaatggacattgatgggactaaaaataagctgagggctgaatggaggctttaacaaatgtacatttaaactctcagtttagtctcatcagccatcacaggaaaggcagtggcaagaatgtttgccgaagtgtcatcttttatcaaaggggataattttagagtggttgtaatcgtgcttattgtgggcctccgcattgcttcatatggaattaggcaacatgttcatttgaaaaaaaaattaaaaactggattaggaagaaatattttactgtcaaaaatcagatcactgttgttgattgatctaaggattcctgttaaattcttaactcggatttatttatttatttatttattttctctctctctctctctttctctgtttctctttctctcctgccttccttccttccctccctccctccttccttcttcccttcctttcctttcctttccttttctcttcccctcccctcttctcttctctaatcttctcttttcttttctcttttcttttcttttcttttgttttcttttcttttcttttcagggtcttgctctttcacccaggctggcatgcagtggtccagtcgtagctcactgcagccccaacctcctgggctcaagcaatccttttgcctcagcctcatgagagttgggtctacagaagctccaccatgtgtggctaatttttaaaaaatttttgtaaagacagggtctcgctgtgttacccaggctagtcttgaacttctggcctcaagcgatcctttcacctcggctttttaaagtgctgatattacaggcatgagccaccatgactcacctttaaatctttcctttgtaataaaatgtggctgggtggtcacaggcctggagtctagggggcattacttgccatttttgttaagttaccatctttaggtgttcatttaagttttaatgttgtatggcttgacctggcacttaggtctgcactttggcaggcacaagaaaattgtaaataccttcttttttttttttttttttttttttttgagacagagtcttgctttgtcgcccaggctggagtgcagtggcgtgatcttggctcactgcaagctccgccttctgggttcacaccattctccagcctcagcctctcaagtagctgggactacaggcacccgccaccatgcctggctaatgtttttttttttttgtatttttagtagagacgggctttcaccgtgttagccaggttggtctggatctcctgacctcgtgatccgccagcctccgcctcccaaagtgctgagattgcaggcgtaattaaatgccttcttgaggacttttataccttcctcttgaagacataaatccagagcttactggtggttgtctgaaaaagatcacatcttgtaataggagtcatacataaatatttctgagatctccctcatacttaaccaccgtgcctggaaaatgcagacaactgtattcagtaaatggtatttgaatataagtaaatcaaaagtgtcgtttccatagattctgtagatgttaccacttagaataattacctgtctaacccttaacaaattctaccgtatattctcagactttgcaaacacgggattccaaaacaatgtggattgttttcagtttctttgaagctcagatttaaatcatacttttactcagtttttaaacctaaacgtggaagtgttatgagatgttgtttttgtgcagctagaattccttgttctactaatgaatttcatttcctgagtccctgtgtctgagtatactgtatgtttcaaatttctgatttagttatgtacctataggcaaatacactgaatggtcaacctaaaaatgcattgtttgactcatatttagagtcatacatatataggcacatgtatttaaaataaatactttaggctagatgtggtggctcacagctgtaatcccagcattttgggaggctgaggtgggaggatcccttgagcccaggaatttgagaccaccctaggcaacatagaaaggccctatctctacaaaaaaaaaaaaaaaaaaagatttttttaattagccaggcatgatggtgcgcgcctgtagtcgcagctactctggaggctgaggtgtgagtgtgaaccaggaagtcaaggctgcagtgagctgtgatggtgccactgcactccagcctggatgacaaagcaagacgctgttccaaaattaaaagttaaaaaatgagataaatacttgaaatattacaattattaaaatagttgttttccccatgggaaaaaaaagttgagcagagctgtgtctttgcactcagaaaaaactcttactctgttgaaggctagtgactcttctaaacaccaaccccttcacctttttactttccttagactttctttggaaaatcaaggagttagcactttttccccctggaagaattaaatgcctctccagaactgcagcacaggaggttaacttctaccacctttggaggcctgcaagctaccagattaaatacttaaagctaagcattcatcatttcttaacctgccctctacagtcatgcacttcctgctttttactttgtcagggctcgtactcaaactattcatagcttcatgaaacaggaactaaatgctgtctgagcctttccccttgtaactctcagcgttctgcttatccttcatagacagaagatgatgatatgtcctgactgttgaagagaaattagacttaatgtgatcctgtacagttaaaccaaaggccagatagggattttttatttcaatcaactttctattgtaggcctaggtttggaaaaccttagcaccccctaatttgtaagacttgaactgttttaaagataagggatacacagccaaagctttctttgtaattctgagatttttggtgtttttacagatacttagtctaaatctttcatcagacagttatcatgattattattctgacttcaacaactgcattttctaaagggaagtgagaattaggaaacattttcctgtacatctgtttatctatcccagttgtgttgtttggattttttcagtgtcttaacgattgaaaccatcttatccatactgaaattcatttcatgcttctatctgctgcttcacattcaggctatcagtttaattgagcaaaaaaaaaatgttggcagtttctatagcatcggcatccttctttggtttctcatttttgaatggttcagccacatgttaaattttgctgagatctctggaaacttcttcacataattctttgatagaacatgaattctgtgagactcttcattaaagagcacggtttcatcactaagttgagattttgctcaaggctatttggtaaattccagcagaagagcaataaatgttcaacaagaaacagccgtcattggagataacaagggtagacattaatgggaggtttgtcacaggtaaacaggtgatggcatgagaaggtttaaaccacctcataaataaatttttcgccactatatgatgtggattacaactaaaccaaactttaaccaatgtgggtgttggtgtacctttcttttctaaagcaaaaaagaaattgtggtactaaacttgagcttttatatgataccgctaattgcccttcacccaacaaaccaattatttctacccatcacttttcgttgcaaaagaaattatcttataaaatatatgtatatagcatatatctccaaagcaaatatgggacatctgtacctcaatgtaactgatagtaagttaaaaattatttgctgggttcttggtatgtggacagatgaatattataatgtttaaggcattccaccagcaggttttgaatttaaccaaaattttatgaagctaatcagaatggaattaaaagttgaaagactgccaggccaaaaagatcatctttcagaaaagtaaataattgctctatacttacatatttattatttatttgttcaccatccgtttatttttagttgagttctgtatacattggtgagcaaagggggactcattagcttgggcactcctaagggcaaacccaataacagatagtgaatgggaaggaaaatgagagaattagcatttagtgaacaaaatcttataaactatgctgaatggtatacatgctctttcagtaaagccactcagtactattacttccctaccttctgaatgtttaccaagttcgataaaatcttgctacatacaaatgggaagtatgtaacaagagatactagtggtttctgggtttaattaagttacatagaacattaagaagtatgttgggaaggcattagcttaaaagctgtcttttgccactgaggccatattcatcacccagattccctccacagtggagcgctgctcagtcactgccttcagaatgcaaataggtcttcacaggatgctattaaaacccatagcaccgtatggttttacgctctgctttcttccagcaaacctacgtattttaatgttaatatatatgttcattttatctttgagaatgaaaatgtattatgaaaatataaatatttagtttttgtagacaaatagcacatttaaagatccagtagttattcacctgcctggtatgactgatagagaacagatgggtagcaaagaatcctcaccctggaaacatgtacgcatacacacgcaaacacaatctcgcataagctttaaggggttcattcattttgtgaaggttgaccatggataccagtttaaagatgccaggtgatgtttggcttttaagtatcatcaccttgagtttccttatataaatgttttaatatcaacaaaaaactcagaatttctaataggtcataacactgcctaggtatgggaagaggagagggtaaaattaaaagaaatgcaaatgtacttttctttgaataggctaaccagttagaggatgtatgaagcaggaccaccatagtccaagtatgaatatgcaaaattaaagcagattgctgtaaatctctcttaaaaagtcaagaatatgtcacagttggcatttttcggatgatcagaccgtttgacaaatctctgcaagggtccgagttagtcgaacatatcttttgcttatgatttcagcaacactgtgcgctttgccttctgggttgtattactaattctgttcatcattaagtgtacacatgtttcactgtttgactaaacaaagcttgaagacatacaagtccaaacattttctgtcctttctgtattcccaggtcagaagatcttagctctttatccattctgtgctagagtttgtctgaaagcatgaatcatggggttgtgttgggtgctaaatttcagttctatatgctgccttcactaatttatgactgtggtctgaacaaccaaaataaattatttctgagaactagcaaaataccctggaaaaaatttatgaaacctaccagatttgtaaaaaggtcagccaggcgtggtggctcatgcctgtaatcccagcactttgggaggccaaggcgggtggatcacctgaggtcgggagttcaagaccagccggaccaacatggagaaaccctgtctctactaaaaatacaaaattagctgggcatggtggcgcatgcctgtaatcccagctactcgggaggctgaggcaggagaatcgcttgaacccgggttgcagtgaggggagatcaccccattgtactccagcctgtataacaagagtgaaactccgtctcagaaaaaaaaaaaaaaaaaagaaaagaaaaaaggtcactaagtgatgagagaattaaaaccactcctattttctaccttttataacataaactcttgtctttacttcccaggtttgccatctttataacctgtaactaggagcaagtgatttaataaagggattcctcctattccgtctgcaaattggagttaatttttctcctctttctgcaatttctgttgttttagcttttgttagccataattagaaaatcaaaaggattcattgaaagttgagacaaaattgtgaagtaggaagatgtcttcctccgtaagaggagaaagattgttagaggaagtacatggaggctttggtgacacatccctatgaggaagtgatctgcttccacgggaaggagagaacagatgatagatgactcctagatgctcctgcgtcatgttcagtacaaaatcagagccgcatcagcaaaccggataccctgggaaggaacattgggataactccttggccataaacaaaagttttgctctggccttatgactaagtggattaatagagattagttgttcaatatccttccatctaatggatccatattgttaaaacttaagaaacaccaaagggggagagtgtgagaatctactgccattttctccattgcttcattcaagacttctgtgtccaccttggcatgggattatcatttgcccttttatactcaccttaaactacaaagatcatttgtttgcctttctgaagaaaggaaggtggataaattttgcaggagactttaaaaattcagctcaactcctggcattaaagacaataaaggtggtgattcagaggtccccatggcagtttccccaaatattacgtttaactaagatcatctcaagcacagagagacttaactctctaaagtgtgatttttaaacctgcacacggaaattttctacattttatatgctcaagatttcttgaaatccagggtgtaaaactgtgaaaataatagttctgaacctatttatgaaagcaggagagaattgctttgttcagttttggaaaccaccagggtgcaatttaatgctccaggagagggttttctgtgacctggaaaggttggggtgattcccgtacagtgagtcatttacttccttcttggcaggattatgcccagggcttttaaacgctcttgacacttcactgccttccataagaaacgggtttagggcacaagtgtctattatgataagatgccagatttctagatcaagcataaagctgtggagtgggacaataggacttaataattttaatacacttcccacgtgaactgtcaagtaataagctacatattcagacgtgactggcattgagtcatcctgccattagtcaaatgtatgagacttttcccaagtcccagcaacaccaaatttgagaaatcgtataaaagaaaaatgaaaaagtaaatacgtctaagaaatggggaaatcaataaaaaatgtactagcaccaggggcggtggctcacgcctgtaatcccagcactttgggaggccgaggcaggtggatcacctgaggtcaggagtttgagaccagcctatccaacatagtgaaacccttctctactaaaaatacaaaaattaggtcggtgtgagggtgcacgcctgtaatcccagctgaactcaagaggctggggcaagagaattgcttgaacccaggaggtggaggttgcagtgagttgaggtggaggtgcaccactgcactccagcctgggcgacagagtgagactccatctccaaaaccgtgttagcttttatcaggaaaggccattaaattttcttcaatattacctacatcaatttgacatcaaactataagaacacaatatgtgagatgttttgaaattaatgaaatgaatcttctctttgagacgagtttgtgcacgctatgaagtccattaaatattttctgggaagagttcccagttaaaactactttctaaagtacccaagcacactatatagatacatcaagtaggtttattaatgtcagtatttcggtgaaaattgggaaggccactattctgagtagagaggtgtttgttttctacttgaagactatgaaggatattctgcactactgggcctatttctgaaattgtatctagctgcaagttactcattaatttaattaacaaatatttattagcaaccaaattgtggcaggaactgtgcctagaggtagaaatacattacgctcttgtttccagagaggaaaatgagtaatgttctaaaatgtaaatcttatgtttctctttcctcttgctgtaaatgatgtctaagccatttcggtggtgcctgttcttaatcctttaataaattattttgaatgattttttaaaaggcagtgtgattgtgaggtgagtttagtacaaattaaaaaatgtcacatcagttgcaaacagacagcacataattatgagctaaacactgtttcagaaacagtagtgacaataaataggattcggtataattagtcctcctgggacagatctcttcctctgttctttgccatatattttaataatgagattagccatctaatgccaatataaccagactgtagtattaatacacagaaaaattattgctagtaacagaagatttaaagacatgagggtgatccggattatatgcctgcaggttaaaaaaaaaaaatgtttcttaaactctctttatcaatatccttttcgtgagccactgaattcttttgtttttctgatcatatgaataacccgtcttaagtatgaatattgtgacaatagtaatagcaattactttaagagaatatgtttctatagagataacagaggggtttttccctaccattcctgtatgaaggtttctgtgtttttaattaaaattttaagaaattcatctttgtcttagcataataaaataaacctcactagacaatcaggacaccttgttattcttagatacattattatagctcaagaaataacaaatgttaagcctggaggatttgtattttggccaaaagttgtgagggcaattatttatttatttgagtgaaatatgcaggaatcatatatcaaaaggagggaggtcttttttttaacctcaacaaaaatataaaagtatagggaactgttatctatgtgaacccagcaaatctgagacaggtctcagttaatttagaaagtttattttgccctggttgaggatgcacctgtgacacggcctcaggaagtcctgatgacatgtgcccaaagtggttggggcacagcttagtgttatgcatttttagggagacatgaggcatcagtcaatacatataagaagtacattggtttggtctggaaaggcgagacagcttgaaacaaaaagcaggaagactcgaagtggggaggggccttctaggtcagagataggtgagatgaacagttgcattcttttgagtttctgattagcctctccagggtagacaatcagggtgattggctctaagcagttcccagctagacttttccctttagcttagtgatttgggggccccaagaattattttctttttacacctgtgttttttctttcttaactaaaaatagtatttgtttctgagggatagagataactaccattttatttggtatgatttatttgcctaccgtccaacaaagaaggtaatctgattttgttttcatttccaagcatgattcctagagatgtgtttaggtggccaaatcaatgaagcagaaccctgcaaattcatttattgggagatatcctaaggtcttcctgaattatctgatgttcccaggctttgcttatccaataggcattaggaagaaaaggcttgtgtttatgtagatgcacacaaaatgcgcatctcagcttacataaacagtgaaggggtttcccaggtctcattatccctggaggagctgaggcctggggagtcctcagagcctcctttgctactctgttattgtggcaggccaaatctcactaatgcaggcctccgtaacagctgtttccgtactgactgagtggttcagttaaatactaaaagctaaaaaaaagccagcgcccttatacagaggctggaatgtaacaaaagcccaccaagagttttgcctaggcctttcctggcaaaaccaaggaattcttaacaggacccatttaggattaacaagttttactgggagtctgaagaaactctacaggcctccaagaacaagtttactggaggtctgcaggaactcctcaaacctccctgatttagcaggagacaagataagagtaatcaccccagcacctagacccatttagattaagtaaatttactgagactccagaggaaggtcttcaggactcagaccttagttatggattaaagaagttaatcacttctgtcatgagatgaatgcacacttacacgtagacatacagcttagaaggcatataagttctggaaactttgtaattttgagttggtctggcactaatttccaggccatctccctgtaaaaggttacaaaaataaaaactctcttcctcccagttcatctgcatctcgttattgggctgtgaggtatagtagcccaaccctcagttcagtccgggaacattattatcaaactctggggattttcaggataagttaggaatatattttgaaggagaatggcagtattaaatgagatcagcaattgaaaacatgtgaatacattcaccatttaattacccatctcaatagaagataaggatgaatttagcactagaaaccatgaatgtcacaaaagcctaactttaataccttgaatcactttccagtaatcctaatcctttatccacatggatagaggacattcctatcttgctctttcttctccccacacattagcttaataattagctaaataatttcatgcattagctaaggaataatggaactccagaaacctaggacagtaattgagagactgaacaagctaaatctgaaccttctgcacaattaaaggagctgatgttagcatggcccacagaatattacctgcacttgtaaaaactagaaagtcaggcaagtactcctggaacagactgtcttttctaaccatgcacttatttctttgtttttaactttgtttttgtttgtttgtttttgagacggagtctcgtcctgtcgcccaggctgtagtgcagtggtggaatctcaggtcactgcaagctccgcctcccaggttcaaacaattctcctgcctcagcctcccgagtagctgggactacaggcgcccaccaccatgccttgctaatttttgtatttttagtagagatggggtttcaccatgttggccaggctggtctggaactcctgacctcgtgacctgcccgcctcggcctcccaaagtgctgggattacaggcgtgagccacggcgcctggcctgtttttaacttcgtaagttgctttgtagaactatcttaaacttggtctattttagattctccttgaagggccagatcacaaagtgattaggagaaggaggctctggagccaagacagtgagactaacccattcttcaaatctaacactaactagctgtgtaaccattgggccagggatgtagcctatgtaaccacaatctcctttgtgcttcatgcctcaccaataaggtggggagagctgctatgactctgtcatagggctgagacgaagatttgatgagttaccagcaaaaagcatttaatatactgtctcattcagaagcagtcaatacacattgaactcttattacttagaggaaagaaaggggtcgatgatttatagataaggcctgagtgaaagaaataaatgtgtattgagtatcagcaatggactacgcatcattctgggtaactatcactgaacacatttaatctgcaaatactatctgaaagatactgccatctgaattgcataggtgggaaaagtcaaggcttttgtgcttatttttaaatgtatgttaacatgaataattaattggccgtgcactggtcgcacgcctgtaatcctagcactttgggaggccaaggcgggcagatcacgaggtcaggagatggagaccatcctggctaacatggcgaaaccccgtctctactaaaaatacaaaaaaattagctgagcatggtggcacgtgcctgtagtcccagctactcaggagactgaggcaggagaatcacttgaacccaggaggcggaggttgcagtgagccaagatcacgccactgcactccagcctgggagacagggcgagattccatctcaaagaataataataataataattagtgggaatatatgctgtttgttgtgataggagaagaaaaggggagatccagatgttggtcatcagaaatgacctgcatcttctctaaattgaaatttagcttgaagtagtaatgccaaggccagcctggggccatggcatcctggtgtacctgcttgttggtgacagtccttttaggacaaaatatcttacaaaaacattcatagatgactaactggaaaaaaagaagttatgatgaaaagcaattcttactgtttttgttttttgttttttgttttttttaattaaaagacaggcagttattctctttcccaggcttgagtacagtcgtgcaatcagggctcactacagcctcaacctcctgggttcaaataatcctcctgaccaagcttcccaagtagctggaactgcaggcatgtgtcactgcacctagctaatttttaaaattttcttgtagagacaggttcttgtaatgttgtccaggctggtctcaaactcttggctgcaagtgatcctcctgcctcagactcccaaagcaatccttacttttttaattgaagtgctttttttttttcttatttaaactcttaaaaattcatcccattttcttcaaaacaataaatcctttacaagggagaaaaatgaaatagagcaactaagaaagcatccatgaaggccaggaaggaacatcatggttaaatgcgattagtcacagccccttctgtctccagtcttggatgaataatggtaacagaactagagagatttctaagaccttggtgcttaataacaagcaagcatcgagggtggttgtgcaagatcctgatcacacaactctgcatatcaaatatccttcacaatcaacaagagtcagcctttaatctctgatgttttcaaatgttctttttttttaattcacatgtataacctatcctcttttcaatatatagagatatagcttatcagtcattacctcttttactacttttcttctgagatttaaaaggtcatcctctgatttgtaaattcaaccagatttcacagttcagatgagagttgtaataagttgccaagaactgttgcaagctgtgatggctgtctttctggggattatagagaagcacatttcttttaggaaaaaagaaggcagatgagcccaagttgttttatttttattgtgtatatgtatttgttttctcaagtacagtagcatggcctctgtggcaggcattcaccaagcaaatacagagcaccctctgggtcaagcactgtgttattggggttccaaataaagaaaaaagaccaaatccagccctgtggatctcacattaaagaggggagtaagaatcatagataatttaatgagttaggtacattaatggggatttgcacagtatttcataggagcacagaaaaagggtacctcgttccacctgagatggcagggagatggctcctaagttaactaagcaaaaggggaaggagaggcacatcccataggatatggataacacaacaaaagctccattaccacccgccccaccaccacacacaccatctctggaataaattttgtaccttccaactggttttcagggtactcatgacacatgggttaataatagctaggtttgcccaaatgaccaaaattctattcccaacatgaattttcacaactggtttttttgtttgtttgttttaatgaagaagaaatgttgtgtttttggaaatcatcttacaaaatcatgtagtggaatgcatatagtgatgaaattgttgaagaccagggaatctttgtccttagtttttattaggatggatgttttcaggtaaaactaaaataaaaatgaaatggaaccaattagaaagaaaataggagcacttaagacgaaatgtaattgttgctgaaagaattagaatctgatagcttagaaagaacttaattaaatttcagagtaaaataaatacagtttagcaatggcctttctcctagaaaaatataatgtctcttacagttcagttactccttggcttacaaaatagtggttaaatttcctgtttttctcattttgatttcgtatgttacatgttactggtgatgggattatctgtgtgacattacctctggtcttcaaaatgtacacgtagcaatgtagtctcacatatgccccttgggtgcgaaaagagaaggacctaacttaacctgacagacctcaaatctgttctctttctatagcagagtactcctatttaaaaagaaaatgttgagtaaggaggacagtcatcatatatgtcgagaatgttaaatgctcttgtggaagtgaaaagcagccgatctaagtaattacccattaagaaaggagtaggagaaatgtttagaaggcagacctgcaaaaaggtgactcacagtacgttcacatgaccggatgcattagtggaacctctaacccatcgccaatggaagaagcagtgttttgcacaaacttgaaaaagagtttttcattttcctcccacagcctcgtcacgtgttcaatatgctaaagaagtatgtccgcgcagaacagaaggacagacagcacaccctaaagcatttcgagcatgtgcgcatggtggatcccaagaaagccgctcagatccggtcccaggtaagcgtggggtataatcatcttctgcagctttgacaatccaggattcttgcttcttgggttggtgacaggatcccaggcattctccgagcacctataggtgttttccctatggcaagagctctttaacttctggtaaattctaaaagcttgtcttagagcaatatgtggtttggcattttctgagttatgaaaataacaaatgtaaaaatcttagtctactgctaactgattgctaaggaactgattaaaaccaatgactaaaatgagaaaaacaaaagttgtataaactaaaatcttgaaaactggttcaactgaagtatggcaggcaatcataaacctactggaatgttgagatttaatgtgagcctaaatgaagcccagtaataatgtattttatactccccggttcccaaaggctgaaaactgggatctaccttaggaaatgtgaaattttacattttcttgaatgaaagagttaaatatatatagcatgaaatagccaatcaaattgaaatacgttgttttctagggggaaatttgcaaagaaatgtatttagggcatgagggtctgtttagagagcctcagtattaggaatcagaggtggcagaggtagcctttttaattggctgttataagcatacaagataatggtaagttttaagataagtcttaaacctgagctcaaaaagttagagaacagaaataggagaacaagaaaaataaagttgccctttcagttcaaccttttaacagtagcagtgtttgtcagttttcttttggaagtttgtatctacctgcagtgcttggtaagaaaaataacctgggcgacagagtgagactccgtctcaaaaaaaaaagaaaaaaagaaagaaaaagaaccattcctacccccagacattgttgacctggagttgtcatcctttgatgcaggttatgacacacctccgtgtgatttatgagcgcatgaatcagtctctctccctgctctacaacgtgcctgcagtggccgaggagattcaggatgaagttggtaagtaagctgttcttttgatgctgcacatggacatgtattttcccccagaggaaaattgaggaagtgagttatctgtttgaggaatatggaagttaatagaacagcttgccttttacgatgaaactgtcaggctggaactagcttactagccttagcaattgaatcagttcttacctctccatacttgtaagactggaggaatgtcgcctgacttagggtatagttttgtaataattggacacttgttattgaattatacgtggcagcattttttctaatttgcccaatcttgttatggctctcaaattatgatgctttggtactttacaattaatggggaaaaaaactcattcttcatcttttgagtgtcacgattgttccatcttacaaatgaaaaagctcaaacttaaaatttgagtaacttactggcctgtgtcacatgcattataagtagcacagccaaaacacataactgtgacttgtgactttgaggttattgttatattcagtaagtcacaattctctttgatggctgagcagggaagccatgagtgttctctgaaccacatcattgtttaaacttaaaagatagtgggctattaaacttatattctgaaataattgtactctcacaagaacttggaaaaatagtacagagaggtctcatgcatccatcacccacatgcctcaccagtgacatcttacgtaactatagtccattatcaaaaccaggaaactgaccttgtgtgcccactgtcttttatgtccctagttttcctaatgactaatgatttcatttaagatctctcatttctgtttctcttggaaagagaatcaaataccacatgagtctctgtcagctgccaaaatgcccataactgtttaacttacttcacaaaggtacatagatgacgattatgttggtgcatctttcaatataagcatatgtacctatactggagatttagtgtgtagtctaccaacatataagcaatatgtatctggcatatccttccccataaagaatcctaccctttgttaattgggttggaaatagatacaggttatcatctggaatcagagcacccaggatgttgtagatggatgtacccattacagtaagtccgactttgaagtgcctgaaacaccgctcaagggaacagctggccctcactttttcccattttatgccagtgttattctgctcattctttcctgatttatgtggccttgtaaatattgtttgtattgctgtgaaatatttggcatgtgtcaagtgatgatgttctgttcagtactgcacattaatggacggaatctgaaattatactttgagctacataacttgcagaagaaacttcatatgtcagggaggtgcagtgtcccagaactttgggaggccaaggtgagcagatcacctgaggccaggagttcgaaaccagcctggccaacatggtgaaaccccctctctaatttaaaaaagaagagaaaaaaagcaacttcatagtgtgccaagcttttgttcagaaggagcaactcagtgttgagcaagaatttatgaagatagtggaggtggagtttttagtctacaccatgaattgagaacagagatctccaattaatttttcactgtatcaagtttctttagcaaacaaatatacttttcaggtatacttggagaatagacatcagtaaggaacctttaaaatactatgtattaaataagtgtaaagaagttctccaaaaagttgtagaaggtacaaaatgaaataatttatcagtcttaatgaactgaagctaaaatcttctagaaaacatggtttgtttgtttgtttgtttgttttttacagctatcttaagcctgttttcacatgtgacttcagttgaagtggcataggtaataactatagggaaataagccattacaaaggactaaaaagttgatgaccaatattccaccctcacccagcaattattgttgactctttataattaaattattagaactttttatttggcactatactactgaaaacattagccactaattagtcacacttccacagaacagatggtggttcagatatcttgaatattacgaaatgcccaagaatagggcagcacaataaacttcaaatctcagtaccagggaggatatttagataactagtatcatggaatctttttctgtaaaaagaaaaaaaaaaacagccattaggttggattaagaacatattagggggtgcagcacaccaacatggcacatgtatacatatgtaacagacctgcacgttgtgcacatgtaccctcaaacttaaagtataataaaaataaagaacatattacgtatgtgctcttaatgtgtgtgtgtgtgtgtgtgtgtgtgtgtgtgtgtatgtatgtaatatgctctcaatccacccattagttgggtttttttaagtaatgacatatatatcattctaaatataccagatgccacattctgaaagataatcttttttaaaaacctttcatttggaatcctgggtgcttccatttttaaatgactgttctctatagaaagagaagtttgcaataacgaaccctgtacactatctgagctgctagtgtcaaagctacagaagtggtttgctggggagaatagcttttctgggttgaacctagttgtcatctatagtcctttttcatttgaaggaacatttaaaacaatacgtccctttttagtaggaatatagttgaaacttcaagattggccaggggtgctaattgcttaagccaaatgttattagaggttcctcatgttattctttttacttttgtatgtgtttaaaatttctcataataaaaagtgttgcttttagcttactttctaaataggttcttcatagattttttttccaggttatgtcttgtagtcgttctaatattctctgattaaatgctttgtcattagtctgagttgcatttatttgctatttctgtatataatcaaattttagatttggagtcagttcagtacaaatagcatactaaaattcagagacactggcaaaaggagaaaattttaaagtccctaaaaatgcatgccttttgtatagaagtttgtgcttataaatacaagcaattaggatgtgcttaatgcagtcaaacatctgtagagagatacaatggtttaattaaataatggtaacagttgctttatggataagaggttttcaccagtctggggaactgccagtatctttagtgggagaggtatatctgcttcagtaaattatgcttccaattagaattctcttttatgggtgaaaatgaggaagaatggagtcatgctgagaagaaggaatgctatcggtgaaggggaaaattgacattaaatttgtgagcagtaaactgtgaccagagcatagggttcatcatgcttgtgagttctggccctggcccttgtatcttccattgtgcttccctgaggcatcctgtctgttcatgctactttcccactaacttcagtgaatcccaaattcatgggtctagccacagccagcgtactgaatcccagtgccatattccagaccccaaatatcccatgtgcctctgaacctgcaatcaatgtgtataacactcatgtccttctggaaatttacttgttttacacactctattctgagttctcttggttggcctaaactatccatgatgccttcctctccctcacccattatttcttattagttgcaagttctgtatatttggccttctgtgttcatgtgaaatctctgcacatcccctacttacctgagatcctgtcctctcatcagtgtcattagactcccagccagtcaccctacctcttatctcacattggccccctcccacttcaattcctccttttcggaactatgcaagttcccttaaaaacaaaagacaaaacaaaaaaaacagctgcaggccggcggcagtggatcacctgaggtcaggagttcaagaccagcgtggccaacatggtgaaaccccatctctactaaaaatagaaagattagccaggcatggtggcaggcacctgtaattcccagttactcaggaggctgaggcaggagaatcacttgaactcgggaggcagaggttgcagtgagccaagattgcactattgcactccagcctgggcgtcaagagcaaaactccgtctccaaaaaaaaaaaaaaagaaaaaaaaaaagctgcttgtggtttttccttgcttgaaaagttgcacctttcaagattcaagtaaaatgcccaagtcctataaaccctttctaatttgcatagagaacggagaaaagagctggcatttgagtgacaaccatgtaaccaactaatgagtgcctctttgtgataatgctgatggtcacattctttctttatgaatgttccccgttgaggtacaggaccgccatatagagatgtggcagtggcaggtggtttagggtaagagtggagactgataattttattctacatcccactcaaggagccaagccctctggcattgtgcacacccactggaagtggggctttcttgcatttcacacaaaggcagcatatgggctagtgaagatactgggaaattcagtgatagcatccccagtttacagttgaagaaattgaactttgaacctaagagagtttgccaacttgcccagcccagatagtaaagtgatgaaagtggggtggaagccaagacctgccagaagtccaaaatctgtgttctttctgctgcctattttcctctctgaagtggaattttcccctacttaacctcaatgtgaaagcactgggtatccacctccaataccatactctaacttggagtaaattatttgtttatatctctactaaccctccatcctgtgaactcttccagatatatgttggtcatccttgcctcctcaagatccagcaaggaccctggtactttttagatattagtaattataaatataaggttgaagccagtccccaggataaaaaggcagatgctccttaacttggactgatgaagtgggctcctccgtaaccctaaagacctgaccaaaactccttccttgacatctagcgtaagcaccacacaaaacaaatttctttcctaggccacagcatcctctaaagctgtgattgatcaagctaactaaatggatgtggttggccaagataacaaagcataaatcagggttctgaggacctttattaataaaattttacaacatggtccttctttgtaccatgaccctctgctatttggtcatctacttgatttaattgtgctgtcctgtttgaccgccaaccacagtctgaagctattcccatgacaaataagtgtgaattttcaagtgtcctgttgtgttataaaaggcccgtgttttattttataatttcatatttttttcattcaattttaattattatgtgcaagttcccaggctcagtcatttattaatgtttttattttttaaaaagttattttcaggcagattatgaagatttcttgcaaagaatggcctcaggcattgtttgtatagagataaaatctcctcttttaaatcactatgtaggtcttcattaatattttttcattcaacaaacgatggaatcattatttcagtgaaactatggctcctcttcagtgttcatattctgctttaattatttattaatccttcaaaagggcagaatcccttcatcctttcaacctttgctttgtcaaattgttacttaaaaatgattggtgttttctttgtcctttgtaatcttccttaaatctctgctaaaaggattctattctactctttgtattggcactgaggttatttatcaaagtgtgcttctctttgcagctacctcaaggctaaaaatgtagctcttttcagagatggctgttttacagaatgctataataaccaatttatgagaaaggcagtaggaaataaagagggaacaaaggcataattgtttcatacccattttttttcttctagcattcaaaattaataaaaacatgaattattataaaccagatgcgggaaagatctctggctgaataaatccatagtgaatggggcaggattgaaagatatggcggggaatcaagaaattcgcaataatgaaaggatgcttattttttattacaattttactgtggcctcttgataaaatgttccactcttcaggaaaaatgcagcatggttatttcaaagacagtgtttccatattctgtttctaataagcctgttgatttgggggtttagtgggtccaaagtagactaggtttaaaatagaatatttatagcacttcccagcccaacaaaatagaaatttaatgttattgagaatttcaagtatccttatgtgtaattgttagtcaaggatgaacatcaaaaaaaaaaaaaaatcataaaagcaaatagagagctgtcactttgttcttataagaacataggtgtgactttgtttttcataagaaatgacttttaaatgtatatagatttaatggtttacagctgacttaagtatttggacataagaactttttttttttttttttttttgagatggagtcttgctcagtcacccaggctggagtgcagtggcgtgatctcggctcactgcaacctccgcctcccgggttcaagtgattctcctgcctcagcctcccaagtagctgagactacagacgtgtgccaccacacctggctaatttttttgtatttttagtagagacagggtttcaccatgttggccaagctggtctcgaactcctgatctcaggtggtctgcccatcttggccccccaaaatgctgggaatacaggcgtgagcccccacatctggccaagaacatttatacatattatcaacaaccaaagccttgttcccccattggtttcataatagtctcagagctccttattcatattttccctagtgttattaagtaacagacatgaggcctgtaagtttagctgcctgtgtctaaatgtatatctttgacccaagacaatttctctttcaaaatagaaccactcatttataaatgaaaatgctttgtcaaatgaatggcaaagtacggtatactattaagacagcctcctagttttctgacatttggactgccatgttgaaatgtctccacacagcaagatacaaatgtgtgaatgccagtacacttcataccttaggtccccaactggtctgtctgcagacttgaggttacagacctgcaggtgtcgaactcacccatagtggtggttagtagagtgctttgtatacgtttagctctctatgccttttttggttgtgatattaggtaagctctctttttcttgctttggagcttaattatggaatctgtaaatatagtgcatatgtcatccagatgatctgtggaagtcattgataatgacctttaaaaattcacatgtaatacagcatccgttttcctgaatgatttttatagttttaccattggcaaacagatactttcttttatgtatttctactccataattttaggaaaaagtaaatccttttagctacattaaaaagaatacactttctaggaataatgaatgtaaaaaaagtttccttttttaaaaaaatattgcgctctctaccattctggcagacaaattgttgaccttaatatgtataattcagtgcagtatattgatcttgtttattgtgctccaaatggacgctggcagaaatttgaggaattaaatatcaaccacagtgttttcttcatgcgattgcaatggtttgttatggattattttgttcagttcaaataaatgatgtacgttcagattctttgcccaattttttaattgggttgtttaccttactttcttaattttatttttatttttatttttatttttatttttggagacagagtcccgctctgtcacccgggctgaagtgaagcggcatgatctcagttcactgcaacctccgccttacggattcaagcgattctcgtgcctcagcctccccagtagttgggattacaggcacatgccaccacatccagctaatttttgtatttttagtagagacagggttttaccatgtttcccaggctggtctcaaactcctgagctcaggcaacctgcccacctcggccttccaaagtgctaggattacaggcgtgagccactgcactcggcctgctgttattattgagttgtaagaatttttatatattctggatactattaaattcttatcaaatacattatttggaaatattttacccattctgtaggttgtattttcacttccttaataggatccttttgacacacaaaaattttcaatttagaagtctattttatcagttttttcttttgtggcagttactatggtatggtatctaggaaaccattgtccgaaacaaggttacaacgatttatacctgttaccttctaagagttttgtagttttagctcttacagttaaatctttgattcattttaattttcatatatggtgtgaggtagaggtttgactttattcttttgcatataaatatccagtgtcccagcaccatttgttgaaaaagactattcttgccaggtgcagtggctcatgcctgtaattccagcattttgggaggccaaggtgggcagatgacttgagcccagaagttcaagaccagaatgggaaacatggcaagaccacatttctacaaaaaaattatccaggcatgataacatctatttgtagtcccagctactcaggaggctgtggtgggaggatctcctgagcctggggtggctgaggctgcagtgagccttgatcacgccacctgggcaatagagcaagaccctgtctcaaaaaaaggaagaaaaagactattatttcccccattgaatggtcttggcactattacacaaaatcaattgtccatagataatatgggtttatttcttaattcttagttcttttctttgatctgtgtgcctgtgcttactgtagtaccacactgttttgattattgtagctttgtagtaaattttgaaatcagcaagtgtgagtccgttatctttgttcttctttttcaatattactttgagtatccggagtctcttgcattacaacatgaattttaagatcttcctcaccccctgcccccactaccatttctgcaaaaaaaaaaaaaaaaaaaaaagtgcggattgcattggatctgtagatcattttggggaatatttatatataatgttaatgaggttttaaacaacacttttatctactagaactgatatttgcctcgaaatgattccaccttgagccccattcaggaacgttagtattttagaagtagcaagagaactgatttagcatgctatcatcttttactccaaattttggtgagattccagagaaattatttgtgagcttttccttaagccatgatgactgacatgtcagtagtttttgtctgtttttatgccattcttttatttttgtgcatgtgtgggcacctcaaccaaatggatggagcctgaggcatggtctcccacgccaaagtctgccgtttcttttgatgatccaatgcagttccaaagctattttctcaactcaccagctcgtttgtatggccctgtaatttgaaacaaaatctaaaaagaaatccaaattaaaatgattgggaagtgaagtcagaccacagtggtggctgtggaactacttcctggcatggaacactagagcagatgtgtcctgctttttttgtagagtcttgggaacaaccaatgattttagactggaacaagggctggttattctgtttttcacaagcatctgccttcaaggttcattttttaaaagaggaggggaaaaaaatcagtgatgtttgccaccctgagtatggagatgaatccaaattgagattaattttgaaatatgtttcccgaattttgagattaattttgaaatatgtttccacaaacactaactgggaatgacatgagtttgtttcatgtgagacggagtttggaagacatgttaatttgcttgttggtgttcaactcagaaacaaattttgcatgtattttctgagtaagtgccattattagttaacagttttcctgccgtatgcactatgggctgctttagaaagtaaatcatagaaggttagttataatatctcatcaaaaatagtggatccatctattaaccggttccaagttatgagacgtgtccaaaggaatgttgacttggtgtgcacctaaacactatttgtgaagaggctttggacttcgagcatgaaacggggtcagagggtcaaggccagggcgttacttaatttcagctcctgttgatggattcattgacttcagatagtgcgtttaaaaaagcctgtttaatgtgtttgtcttttgataattattatgtatttacatatgctcctaaaagcatgagttaaatcttatttctttgaaacagtgcttggcaacaacttgtattgtcttgtacatgccttttgtgtctttgcttttggttgggggggggcattgaaatttgtctgcccatcccctgagggcagatactgaggtgtggacctatgtcttcagcttcctgtatagcattgaagttgctatagctgcatgttctctaaaatttttatacatgcgatttaattgttaaagcttatgatttttaagtatagtattctgatagcaaatagattttgtcaaataaaaactaactttatcatcaccactgagatatcactaggtatatggcttagttctcagtcaccacttttatttgtaaggaagtcttagaagttttcacaagtgtatatgtgatagactgggcacagtggctcacgcctgtaatcccagcactttgggaggccgagtcaggcaggagttcgagaccagcctggccaacatggcaaaaccctgtctctactaaaaataaaaaaattagccgggcatggtggcacatgcctgtaatcccagctactcgggaggctgaggttggagaattgaacctaggaggcagaggctgtagtgagctgagatcctgccacttcaccctagccagggcaacagaacgagactccatctcaaaagagaaaaaaaaaaaaaagctgggtgcggtgctcacgcctgtaatcccagcactttgggaggccgaggtgggcagatcacctgaggtcaggagttcgagatcagcctcaacatggagaaaccccgtctctactaaaaatacaaaattagccaggcgtggtggtgcatgcctgtaatcccagctacttaggaggctgaggcaggagaattgcttgaacctgggaggcagaggttgtggtgagctgagatcgcgccattgcagtccagcctgggcaacaagagcgaaactccatctcaaaaaaaaagaagtatatatatgatgcttgctttagcagcacatatactaaaattagaatgattaaagagattaacctggcccctgcacaaggatgacatgcaaattttgtaaagtgttttatatggaactttacttacatgaggtacctagggtagtaaattcatagatacagaaagtagaatgctgattgccaggggctgagaggatgagggactgtggagttagtgtttaaagggcacagaggttcaatttggcaatattgaaaatagttcagtggggaagatggatggccgtgatgcatcgtccatcacattgcacagcatcgtgaaatatacttaataccctgagcgttacacttaaaatggttaaaacagtaagatttatgttatatatatttaccatgataggatatatatatgtatattcatatcattcgccattgtgaatagcaaggagattgaagaaataaggacacaggatcttcaataaatatgtattaaatgcttcccatgttccacattctttgtcattgccagacacgtcacaggtataagggcccaatctttgttactcaaataatttagaataatttagaatttgcttggggagactttggataaacagttaagaagctgtatccattaggtaaagggacattgcttgctgcgtctcgtagcatttggtagtctcgttagacagccgttcttactcctatcgtttgctgaaatttattagcaaaggaaagaatcttagttttcagctcgttcagccgcatgatttcataggctcaggaaaaccatgtaatatgcccaaggtcagacgtgatgaataagactaaagactgaatctattccagtgtctctgtgtccagtgatacttacttactgctgttgccaagttaaacaaaactgggtttgcagagctgtttattcaccttcagcatcttttcattgaaaatgcggtagatagaagaaatgtccctcttttagcatttgtacctcagtaataagatgcttcccaagctcaaagactccacacccttaaatatgtaagtcagtgttaagatatttaaagagaacatgaatatcagctacattgtgcatgttgcaggatttttatattattttgtatcttctgcttagaagtcataagccagcccatgaaccatgccaacaaacataccttcttccatgtgattattgcagccagatttttcagtgcaggacaagcaaagttttctctgaaagcatgagataataattctcagccaggtcttcgccatttgcaagggatcagacataagagtttttagctctgttgatgttaatagctagagcccctgttagcagatggcatgttagtggcctgttgctgctggctattaaatcatacacattggccaggcacggtcggtcacaccagtaatcccagcactttgggaggctgaggcgcacagatcacaaggtcaggagtttgagagcagcctgaccaacatggtgaaaccccatctctactaaaaataaaaaactaggcaggcatggcggcacatgcctataatcccagctactcaggaggctgaagcaggagaatcacttgagcccgggaggcgaaggttgcagtgagccgagatcacgccactgcactccagcctgggcgacagagcgagactccgtctcaaaaataaataaataaaaatattaaaagtaaatgatacacatcatgagatcatctcccaaggcagcagagaattttgcgtatttttttcttagtttatattgttgcaacagagtaattcttcttgatcacagactttgctttttttgttgttattgtttctaagtttcacttgatcctcaaaataacctgagacagacaaaacagataggttttcccattaatctccttcatgagtctgactttgccagccaggctgatcttatatccatagccctggatgcatttatttatgttattccatctgcctataatgcccatccccaatcttggcctattacatgtgtctaacattactttgatgtgtacatgtcagtgaattaccacttaactgattgttagctttttgagagtatgtatcaaatctcatgtgcatttgtgtgtcctgaaacaaattattaggtataaagtatgtattgcaaataccatgcccagggaatatttcagagctgtggttctccaagtgtggtccttagtctagcaacatcagcatcgcctggcatcacctgggaacttgttggaaaagcacattccatgatcccacccctgacctcctgaatcagcaaagctagggatggggctgagcaatctgtattttatcaagctgtccaggtgacattgataaatgctaaactttgcgaattactgatttagagactaatcaactcattaaaaagttaataaataggtgagaatccattgtagcaccccagtcacctatgctattatcttctaaattcacattatacaaattgtatgccacaaaaatgtttaaggtgaaaacccaaaggaattgatgcattggattaattcacaaaaatataacagctgcaattcatagaaaaaaaatgcatgcatatctgataattagttgtagattaaaaggtgaacaacttcttattattaataccaatgaaaatgtaattttttaaaaattatggccaattggtagttttttaaaaatctgttatgccttgtcatgataaggataggtgaaaaggaactttcataaactattgctaagtatatgggtgaaaccttttagactatttgggtctacctaataaattaaaatgttcagtcttttctaattttagcaccgtatttctacagatacactggcatatctgtggagaggggcacttctgcttgtcacctgatatcccttactactactaatatttttataagcattattacctttaaaatcatgttaaagggtaaatgatgtgcaacagactcagtttccccttctctgactcctgtttagtttacatctcttttctctctctcatttgggggctcaatacccttaagattatagagaaattgcagtaggtaatgttggctggaaatgctaacttgtaagaaacttgggtggaaatggtttaagccatcagcctaaacgatcagtgaaaatgtcagacattctccgctttcttcttccaagatactatactctactgtggccttagagttcttaattcctatataattctgattaaaaaggaaggagatgctcctaatataccttgctgttgtcccctcctgttcattagggtagctgatgtcagtcaaaataaagtctagaaattcttgagtactttttttttttgtaatatactgagaatgcttgaagcaaactaaccaaatttaagtgttttaaggatattaacagtaacaggagagcccctcgattttctgctaagaatcaacctgaacagtttccagactgctggttggcaatgtcagtatcatgagaaaaactgaaaaaataagaaactttagagaaaaagaggaatcagtgcaggctaggggaatgaacttggtaatccagtagtctttccctgccagcattttgattgataagctaagtgtctgctttttctcatcccttattttttggcaggaaaccagtattttgacacttgaatgccttctttctatcttaagggagaagccttcttaaacttcaagtgtgaagtagatcctttaggtataggatgaaaaattaagtgggactatttgtgaattactaaatcgcaaccattaaagaaactaatgccctaattagcctgtcttttgacagacatggcatccatatgtaagtctaatattgtatgcaaatgtgagacaggttttgctttctagatctctttgatgtgaaaggaaaagctggcttcctggcttccttcccatgttctgtatggacctgccttcatcctgctgccaacagctcctcaagggaacatgaaagtggaattaaaccctcctggttttcagattcagaatcctgggtgattaagtggcttgatcaaaatcagaaactgtgaaagtgctaaaaatggtcaaggcccaaggagttcctcatgtgtggtcaaaagcctttcagaaatcaaagtgtgtctttaaatacctggggtgcaaaaatcagatgttttttatttaaagaaaaataggtatattagagcagaactgggggccctctgtaggagcctgagtctgggtgtttactgtcgtctaaggccttgttaatgtgggcttgaggcttcggaatccacgaacaggggaagctagcgtctctcgctgactccagtcctagctcgagctttccatactgccctacgtgacttctgcacttttgtgccatcagccagtagactgagaaaagtatctggtatttgtcggtgtcttcggtttagctgctttaagtccttggatggaaaaggctgattgtcatcctgaaatcattgtctcctaatgtgtaattggggccaagtgaagcacagtaatttagaggaattctagttaaaaatacagattcttgggctctacctcagacctacagagatctgcatttttcttattcccccaggtgatcctttaaacattcagaggtttttaaaactcatgcttatatgcaataacaaaaatataaggattcttagaaacttgttatatttgtcttgaacatgggatgacagacattgtcattttcattgaaaaaaaaaatgaagcagagactcagaatgtatttagagacaactctaaatacattctggcagagcctaactactggattgcagagatcctccctgcttcccccagtccccatctataaactggccatgtgaatttctagtggtgttcacttccaaagtggtgattttataaaatattacaatgaagcattattaacctcaagaagttcagatgcatagagagtttatttgggtgtggcagcattagtggctaggttttatttatccaagataagacttcttattagctatgaaaagggattggcataaactgcttattaatgtccattaactgtatctaaagggaataaacagtataaaaggccaggcatggtggctcacacctgtaatcctagccctatgggaggctgaggcaggaggatcatttgagcccaggagtttaagaccagcctgggcaacatggggagaccctgtttctacaaaaagtcaaaaaaataataagctgggtttaggggtacacacctgtaatcccagctagtcaggaggctgtggttggaggatcacttgagcccaggagttggaggttgcagtgaggcctggcggcaccactacactccaggctgggtgacagagggacgaccttatctcaaaacaaacaaaaacaaaaaactgtataagcataagatgggcttgagtcacaaaattctgcctttcataactttcccccatttgctgtttgatttgctgtttcagaaattgtgaacctacttctctacttatagaacatttacctccctcttagattcttccctttctatcattgatactgacattctgcttaaagaattatccatttaggctctcttcaaatccaaagtgatattattttattttaataagagatgaaagggaaaattgacaaaatgtgcctggagttgtcagcattgtaaatgatggactgtaaaagcttcgtcttggaagattgtcagagagcctagtgccagctcaaaaagtgtggtctttttagagaattgacagaaatgttacaaagaaaacatgtgctgaataccaactccaggtgcgaatcctgagaagcaactcactctattctgcagtaggagatgaattttgcaggttatacagcagagcaatttaaactcccttgtttcttaaagtatatcctatagtgacttgggatggaagtcatatactatccccttttttgttccttcaaagtaaatacaccacagagctggagatgtcccagacacagggggaagctgtttggatttttcccactgcctgtaatgaagcaagatagggaggaagaacttgggaacttgcgtggcaaatggtcaagtaaagaaaaagaaaagctttttctttacttgaccatttgtcacatgtgctttcaaatcctgaactgagtcacatctgaaataaatcacttccttgtcatttccatgaaaggggcagtacaagaaattccttgcacatccctggtgagccccttgttactctcagattcagctattgccttcaggaaaaaaagaaaaagaagccgaagaaagaaagaaaacagaatcctctagaaaaagctattctgacctgtgctctttcttttgtctgagtgtgactagataaatgcattagtctgctagggctgccataacaaaataccaaaataccacagactgaatccttcaacaacagaaattatttttctcatgcttctggaggctggaagtccaagatcaaggtaccagcaggtcggtttctgaggaggcctctcttccttgatttacaaatggccacctacgcatcatgtcctcacatggtctttctcagagagaaagagaggtgtctcttcctcttcttcttttgttttgttgagacagagtttcgctcttgttgcccaggctggagtgcaatggcacgatcttggctcactgcaacctccacctcctgggttcaagcgattctcgtgcctcagcctcccgagtagctgagattacaggcatgcctggctaattttgtatttttagtagagacagggtttctccatgttggtcaggctggtctcgaactctcgacctcaggtgatccacctgccttgccctcccaaagttctgggattacaggcgtgagccccgcacccggcctcctccttttcttataaggacacctgtcctattggatcagagtcacacccccatgacctcatttaaccttaattatctctttaaaggtctgatctccaaaggtcccttgagggttagggctttgatacatgaattttcaggggcacacagttcgatccatagcagttggcttattcatactttgggtagatcctcttcatcgttcctcagctactgtctatttagtgcacagcttctttatcctaaagctagtcaggggaggcatggaaggtattatttctcctgtttctgcacctaaggcattaaaacgaggttgtggtctggcagcctaaactcggccttgatgaacttcaaatcctagacctccttggtatgtgaagtgcatacacttgtatggagggatttgacaggttttttttttttttttttttttgagacagagtctcactctgttgcccaggctggaatgcagtggcacgatctcggctcactacagcctccgcctcccggtttcaaatgattctcctgcctcagcctcctgagtagctgggattataggcgcgcaccaccacacccagctaatttttgtatttttagtagagacggggtttcagtatgttgatcgggctggtctcgaattcctgaccttgtaatccactcgcctcggcctcgcaaagtgttgggattacaggtgtgagccaccgcgcccagcccagatttttttaaattagtttttagtgtatccacactgttaaagcaggtggatactgctggatagtataacaaagtatagtgtgacaaacccataaccaagcattgttagctatattttctcatgtcttgagccaaaaggtcacagttaacctaatgttgctactaaacactcataccataaaacattctattccagtcttccagattttacacaagaataaaatgaaaacttttagactactggagatttttttttaaatacacaatttgttgaatgtgaacgctaaattgaaattgacatgctaagttttatagattacttcagctgccctgacttcagtaaatttagttgtgacacaggtacaacagctgacttctttctggcattagaggtggtgatgtttcgtcactctggagttagtaaaacctgaaacccgccaggcatttgacacacagtttgctgccagggacagctcagcttctggcttattggagaggaaatgacctaacctctgtgtttacaaagtgtttgaaactgaggcccttccacttccttgctgagtgtaagggttgacctggcatccaaaatccccatgatcttctcaggataagtcatgcagccattggtggtcaagaaaggatttgttccctgtggaagggcattggaagaggaacagagctgaaacacacgggtgttcagagggaaaacatctctgcacttaagagggctagattagactattagactattatcatagagctcgtgattcatctcctttgtttaattccagccttgagtaaaggactcactaagaaaccacattcggccgggtgttgtggctcacgcctgtaatcccaacactttgggagaccgaggcagatggatcacaaggtcaggagttcaagaccagcctggccaatatggtgaaaccccgtctcaactaaaaatacaaaaattagtcggggatggttgcgggcgcctgtagtctcagctactcgggaggctgaggcaggagaattgcttgaacctgggaggaagaggttacagtgagccgagatcacgctactgcattccagcctggtgactggagcgagactccatctcaaaaaaaaagaaaccacattctattccagtatatttattataaccagaaattcttgtcttatcagcaaatagctaatattcacttacatgggcagtgtattagattcctagggctgctggaaccagttaccacaaaccgcatggccgaaaccaacagaaatatactctcattatctcattattctagaggttagaagtcctaaagcaaggtgttgccagggccacactgcctcttacagctctaggggagaatctgtttcatgcctttcgcttgctctagtgctgctgccagcccttgatattcctttggttggtacatgcacccctccaatctccacctctgtcttcacatggtgttactccccatgtctctgtttctgtgtcttctctaatatgattaagggcccacccttctccattgtgacctcaatcttatatctgcaaagaccctgtttccaagtaaggctgtattcttaggtgtaggcattaggacttcaacatatattttgggggaaaattcaacccataatgcggttatgtttttattttccttgacttttaagaatgtgaactattgtcaaattttttcaaccactatcaaatttaaatctaagaactacatgtcttaaatttatgacctcttcattaaaaaaaaaataataacatttaattggtaccaaaacgtgaaagagtttaatgctttgcatttgcttgaggctgattaatgagtaaatgtgtcaactgtggctgttttaattagccagggttaattaatgtttaccacacttggaagatgaaaaggcatgtataaatgctctataatgtgaatcattttttaatttgttgttgaagcttatagtgtagccaagtaaggattgcttacatcatacttacaaagggaggttcattaatggatacaaatacacagtttgatagaagaagcaagacctagtatttaattatcagcaaggtgactaatttacagtaatctactgtatatttaaaaatagctaggagaacctaatttgaaagtttctagcgtaaagaagacaggctgggcacgatggcttacacctatagtcccagcacttgggaaggccgaggtgggaaaatcacttgaccccagcaattcaagactagccagggcatcatagtgagaccccatctctacaaaacaaatatttaaaaattagccaggtgtgatggtgcatgcctgtagacccagctgctctggaggctgaggtgagaagatcacttgagcccagcagttcaaggttcaagtgagctatgatcacatcactgcactccagcctgagtgacagagagagacccttcctcaaagcaaaaagaaaagaaaaacatttaagtgatggatatcccattatactgatttgatctttccaaattatatgaatatattaagttttctcatataatctgaaaatatgcacatctattatgtatcaataaaaaataaaattttaaaaatgtaaaaaacgatgttggagcactatggtacttaacgtagaggctctgacttttgaggtacattcattacctgttactgaagttgagtatgctttaatattgtatgtttagaaaaggtagttacatttttaaatctgattgtgtaagaagaaaagagtagaaatgtttggggccaagtcaataattatttagtatatcataatttgagatgaaatgtgtttttttttttcttttttagtttcaagttgaaacattttaagaacagataaggaaaggctaactgtgctgagatgaaaataacatttttaaagtaactatcttaaagaaaatacatttctagaattttgtgtaaattttcaacaaagactcagaagcctggatgaggtcttgtgccaagactggaaagtgtggggattagaaaaagtttgaagagattgttgtgagatcctctcgtatgaggcctgaagctgtacatccatggaaagcagttaccccaggcgggaaaacaggttatccattctcgagtgagtggccgggtgggaaatagtccatcatgtcgaatggatcgtactttccagcaccaagatttgtggttctctaggtgaataaagatgacaccccttcacttcacttcacttcaccattgtctgcatggagtacgtatctaaaaacaaattagcaaaaaggttgggtctactttacttttcatctcctacactattttcttctttgttctcggcaggaaaagatgaagttgcattttattattatctcataggattcttattctaaaatgatttgatttaaaacccattgcactttatttggataaaaaatgcttcactctctagttcttaacaataacaccagcctgattttattacgttaagcactgcaattagacaatacaaagaatttgcagcaacaacatgttattttatcatgggtggaactgttcattgtctagcagaatttattaccagataaatcccttttggggaatctaatgtggatgtttttttcaaagcgcctgtggagttctgctagtattgggaacgtttccattttcattctgatgcttccctgtgggctgtttcagcatagaagtgagctctctgggtccatgtttccattggctccacccaatattctgaaagattgcaactcaacatgtgtaaacagaacctttctcccccatattttctcttttcgtagattaaactcaggtcaagaattagaagtttatcctccaccccgatagcatctcgccctatcccaaataccgccaccaaaatgcccactgtttttccttgggccagttcctgaaatatctttctggctgtatcactcttgtgtgcatccttatcggctatgcttttggccattttttactgctgactttgtctggttagtcttttataatctccaggcttctcctccatcctttttttacagtttacctgttcatgaagcgcaggtcacttgacccgtagaattcccataggctgggattttgctaattgcatactcatggtataggtcagtgtattcctctgccctctgtatcccacaaactgaaagcctcttggctaagctgcttccctttttacttcccttgtaccacagcagccagaagagtcacagatcctgggcagcttgtcctctgtgcctcggtacatgcacttgtatctgctaggacaatgatctctttccctggggccccactgtaatatcactagtcacatccctaaagcccaggcttgtttctttgtcattctgtcggtatccctaccataacacttgtaatagtaattatttttatgcccatcttttcttctgaaccatgagcccttcaagtgaaaagaaattgatgaagttatttctagcactcccctggaaaaaggaaggcaggcagggagggaggggctcactagtttatgataaagtggtttgattttcttggttgcagattatttcttttaaagtgactcttttcagcttctctcactcctgtgcatcgtgaatgctctcctgaagacagacgctttccattcatttccaagccccccatgtgaagtgctttctgttgccaggcttggtttccccacacgttgttaaagaagttaaagaagcttgtgaataagctaaagcagaggagaaagaaccattgctatatctagaattgttcaccagaaagcaagttttgtgttaaagaaaacacgagtaggccactgtgcagaagtgcttacagggtttgtgtgctttttaaaatctgcataaataaacatttcaaatgagctatcatatatacaaggatgatgtgctgtctgtgggaaaaggacccaatcctgtgttgtgattttacatatatatatatatataatttgtgctattacacacttgcctgatccccttataattatctgcataagtctttttaggctctttgaatgaaattcactatgtatggatgttgaaaatcatcctttctaccatgagctcatcagacttgctaaccaattctttgcatcctttgaagtataaaattccatcaattcagcatgtatcaacatgaatcaattagaatgcactttcttcacagcatggcggagtttttgctggctgccgggagcggcactgtttcccaattcattcatttgcttgggcccgccccaggatccttcttatcccggtcagatagacttctctcatgagcttgagagacggggctggtcacacaggacacggctttagggacacgactcactgaaactacaaaatgagtgctgctcttagagttgtacccacagcctgcacagctgttatggcaatgctgtgggcaagtcttgctacggcccattctcctccctcccttgtcctgttggaaggttcaggttggagctgaaattcagtccagcacgcagctggacaagccatgtctcctgtatgtgactcactccccagagaaagcatcatgtggactagtaagggcttggctttatcagaagcaaaggagaggtttacatctcttcttgctctctcttagtgggttcagagctccagcagaaaaaatgggacactgtggattgatctccagaaaaccccaaaaccagcactgaaggctccaggagattatgcctttagattgtatacaggcaccagaatgacttttgcctttataaaaatgcgtgcaagagcatgaaaactaatatttgaggaatttttttttctcactgtactttctggtcctcactgaaagcattggcagttttaaaaaatgaaatgtgatactgttatagacgtagcaaacctcacgtttcattttttccaattcattctatatctaagaacttacttagaaggagaaacaaactgtacccagaaaaaggaatgaaactggagaattcttcctcatgattcctctgtgtcctcaggcctaattatcctcattccaaagactctccattgcctcaataacttcgaaaaatttactctccttaagcatagtcataaaaattgcatagtaaagtgataaagagacgaaaataatgctgtaagaataaaaccattaaaaaaaaaccactactcttgattatttctgctgttagaattgtaaatgaattctcattccttttttctacatttttggcatgaaatttatgttactcttataattagtaaaaacattatattttattaataaaagaagactcacagtgaagtcataacatatgctgcagaggttagactcttcaagtcagatttgaagagagaatttcacgtaacaatcaccttgaaatgtcttcaggtcagccatcaaagtacacatctctcaaccagccaggcagccagtttttcctccagcatgtgaagagtgaagagatagctgtttcttggcttaaagaccatatgaaataattgacttatgtttaaaagatatgagggatcaggccgggtgcagtggctcatgcctgtaatcccagcactttgggaggccgaggcgggtggatcacaaggttagaagatcgagaccatcccggccaacatggtgaaaccctgtctctactaaaaatacaaaaactagccgggcgtagtgatgcgcgcctgtaatcccagctactcaggaggccgaggttgccatgagccgagattacgcctctgcagtccaacctggtgacagagcaagactctgtctccagttaaaaaaaaaaaaaaggcatcaaaattacattcacttctatttttatttttgtttgtagaagacatgcagtttgtatcacattaatgggcatatgatgtaatttcactataaatcgaaccagaggaagacatccaaatatgtataaattaaagctgacaatgcctacagtactaaactttttgttttagtataattggagacttagaaaagttctaaaaatatatttaaaaatttttaaaggaagttgcagacataatggccctttacacctaaatacttcactgtacgtttcctcaaaacaagaagatatgtgtgtgtgtgtttgtgtgtgtgtgttgtaatcttaatacagcatctttcagagattatttctgtagtatataaacttggtttttttgtttgtttgtttgtttgtttgtttgttttgagatggagtctcgctctgtcgcccaggctggagtgcagtggcacaatcttggctcgctgcaagctccgcctcccaggttcacaccattctcctgcctcagcctcctgagtagctgggactacaggcgcctgcaccatgcccggctaatttttgtatttttagtagagacgcgatttcacctcgttagccaggatggtgtcgatctcctgacctcgtgaaccgcccacctcagcctcccaaaatgctgggattacaggcgtgagccaccgcgcctggccataaagttgttttttagtctctactttaagttcctgacaacccaggcaggaccaagactccctaatgtagttggaaatcagatcagcacattggcacaagttctacaggtaaacgggaaaaaggagccctacaatctgcttttagatgccagggagcctggctggtctttatcttgattactgactgatgccactggtaggtctaagttctttgatctatgatgtttgaaagccaaaaggaaatgtgttttaaaggaaaagggacttcttctgtaccctcagtctaagccagacaagtgatatttcaggaaaatgtccctagcaataaggaatattttcacaaatgatgtgaagctttgtttgtgtcccttccagggcagtttgttaccataaggggacaaagcatgcttcatttaaacatgtgtggccaggaaactgttatttttaaacaaaaataaaccccgatttagacatgtagtctgagttttaactctgggagattttcaagattgatagtgtagctaaaaataactgacctaattttctggaggtcaagataaaaactggatttatggtacagcatttactttgtgataatatgtgtataaattcttccccaagttggaaaatgtggccgcgtcatacagggctgtatctctcttgaccattgaagtgcctaggtcgctacactacaatttgacttagagttggtgaaacttctggccattcacgtagccatcgtattcatcctgagaaagggaaacctaaagacttgggagagtgttctgggaggaaagtgctattgagaatgggctgtccaagcaaagtgacaggcaggcctcacttagctagaagagggagcttttcagccctgctccaccatcaggaatctccgtgaccttggactactgctttaatctcttttatcctggcttctaaaagataccgtcgaattcattctttttcaaacctatcaaaaatttgaaatgtatgaaaaagagggtgcttgtgatgatagatgggtttatgcttccttttttttttttttttttttttttttgagacggagtctcactctgttgcccagactggagtgcagtggcgcgatctcggctcactgcaagctccgcctccggggttcacaccattctcctgcctcagcctcccgagtagctgggactacagtgccaccaccacatctggctaattttttttgtattttcagtaaagatggggtttcaccatgttagccaggatgctctcgatctcctgacctcatgattccaaagtgctgggattacaggcgtgatatgcttctttaatattagtttctaatccaagtaatatagccatgtcctctataaaatggaacttttcatggaacagtgagaaggttgcattaggaattgggatacttgggttcagatttcagttctgccacttgctagttttaagtatacttctcaggatggatgtcagtttgttcaactgtcagtgggagtagtgatcccactaaggaagattattgtggttatcaaatcagcagatgggtatgaaaaggccatgagtgcagttctcatggttatgaaggtgtcataactggcatagtcccatcacagtatggctttggcatcgcagatggctgtagcatatatgctaatcagaacatccctaccgtccttaaagatctcatgggttctctcccaaatcagctgctccaccgacctacaagtaagtccatgcttctttagtatatttactcactagtgaaggcccgtctgctaaaagtgtcttcagtaggggagagctgctcttttctgggaaacccagcaatgaagtttgtcctgtgatgccctctacacttactgacctgtttcctgagaacttcccgtaacaaatggtccagggaagaaggaagtctgtgaccagtctttcctttcctgtggctttctggttcagaaatgtgaccctgatgataagaaacttcaaggcatgactctggtgttttggcaatattcccctggcagtattgtttcttggctcacactcatctcatgccttgctttgtttgctttgtttttgagaattgtttttttgtttgttgtttgtttttggttttggcttgtgagacagagccttgctctgttgcccaggatggcgtgcagttggcacaatctcggctcactgcagcctccacctcccgggttcaagcaattctcctgcctcagcctcctgaataatggggattacaggcacacaccaccgtgcctggctaatttttgtatttttttagtagagacgggtttcaccatgttggccaggctggtcttgaactcctgacctcaagtgaaccacccacctcggcctcccaaagtgctggggttacaggcgtgagccaccacgcccagccattatgtttgtttttctttcatgaagggataaccgaggctgttgtgtggtggtgtcttggtacagctcgtggctgtggtcagtgtggtggagggtaggtcttctcagatggtaacatgcatgagagtcacctggggatcacattaacatgcagattctgattccctggatctgggtgggacctgaggttctgcatgtctaacaaactcccagagaacacccatgtagcaagagtacagacaaaaggattcaaagcgaagggactgcaagaaccatggaaccagcctcccacgattttgcggatgacgaacccgagccttggggagtttcagaggccatggagagatgaagtataataaacagcatagcagttgtatgttgagccaagaatcagacatgcacagaactgctgattggaaaattaaatctgtttctcatagccctggtgtgggcaaaatgcctagctggagtgggtgaccgcttgatttacagtggggcttcttggtagggaaaattagtccatcccatttacagctacttccaatgcagctgtgtcaggggagagagaagaaaggacatggaagagagcgtagaggtatgatcttcagtcctttcaggcaggcacataagtaaatttttatttaaaagataagaattggtcatatgcgaatctcctgttagataagattaaaaacaaatttccattttgtggagaagttgcagataaatatttttccatgggatccaaaagaatcaaaaaggaaagaaaatagtaatagcagtggaggttcgatcctagacagaagaaaatccagcaagccgagggacttcatattctcactggtgtccaaatcagagctttttttttttttctttgtttactttaagttctgggatacatgtgctgagcatgcaggtttgttacataggtatacatgtgccttggtggtttgctgcacccatcaacccgtcatctaggttttaactccgcatgcattaggtatttgtcctaatgctctccctcccctttcaccccacccctggacaggccctggtgtatgatgtccccctccctgtgtccatgtgttctcattgttcagctcccacttatgagtgagaacatgagtgtttgggtttctggtcctatgttagtttgctgaggatgatggcctccagcttcatccatggccctgcaaaggacatgaactcaacctttttttttttccttttttttttttttttgtatttgcaaattcaaatctttttttttttttattatactttaagttttagggtacatgtgacattgtgcagcttagttacatatgtatacatgtgccatgctggcgctgcacccactaactcgtcatctagcattaggtatatctcccaatgctatccctcccccctccccccaccccaccacagtccccagagtgtgatattccccttcctgtgtccatgtgatctccattgttcaattcccacctatgagtgagaatatgcggtgtttggttttttgttcttgcgatagtttactgagaatgatggtttccagtttcatccatgtccctacaaaggacatgaactcatcattttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcctttgggtatatacccagtaatgggatggctgggtcaaatggtatttctagttctagatccctgaggaattgcgacactgacttccacaatggttgaactagtttacagtcccaccaacagtgtaaaagtgttcctatttctccacatcctctccagcacctgttgtttcctgactttttaatgatcgccattctaactggtgtgagatgatatctcatagtggttttgatttgcatttctctgatggccagtgatggtgagcattttttcatgtgttttttggctgcataaatgtcttcttttgagaagtgtctgttcatgtcctttgcccactttttgatggggttgtttgtttttttcttgtaaatttgtttgagttcattgtagattctggatattagccctttgtcagatgagtaggttgcgaaaattttctcccatgttgtaggttgcctgttcactctgatggtagtttcttttgctgtgcagaagctctttagtttaattagatcccatttgtccattttggcttttgttgccattgcttttggtgttttggacgtgaagtccttgcccacgcctatgtcctgaatggtaatgcctaggttttcttctagggtttttatggttttaggtctaacgtttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtaggtatgcggcgttatttctgagggctctgttctgttccattgatctatatctctgttttggtaccagtaccatgctgtttcggttactgtagccttgtagtatagtttgaagtcaggtagtgtgatgcctccagcttcgttcttttggcttaggattgacttggcgatgcgggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtgtcctcttttatttccttgagcagttggtttgtagttctcctttaagaggtccttcacatcccttgtaagttggattcctaggtattttattctctttgaagcaattgtgaatgggagttcactcatgatttggctctctgtttgtctgttgttggtgtataagaatgcttgtgatttttgtacattgattttgtatcctgagactttgctgaagttgcgtatcagcttaaggagattttgggctgagacaatggggttttctagataaacaatcatgtcgtctgcaaacagggacaatttgacttcctcttttcctaattgaataccttttatttccttctcctgcctgattgccctggccagaacttccaacactatgttgaataggagcggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtctttggctctgtttatatgctggattacctttattgatttgcgtatattgaaccaagccttgcatcccagggatgaagcccacttgatcatggtggataagctttttgatgtgctgctggattcggtttgccagtattttattgaggatttttgcatcaatgttcatcaaggatattggtctaaaattctctttttttggttgtgtctctgcccggctttggtatcagaatgatgctggcctcataaaatgagttagggaggattccctctttttctattgattggaatagtttcagaaggaatggtaccagttcctccttgtacctctggtagaattcggctgtgaaccatctggtcctggactctttttggttggtaaactattgattattgccacaatttcagctcctgttattggtctattcagagattcaacttcttcctggtttagtcttgggagagtgtatgtgtcgaggaatgtatccatttcttctagattttctagtttatttgtgtagaggtttttgtagtattctctgatggtagtttgtatttctgtgggatcggtggtgatatcccctttatcattttttatcgtgtctatttgattctcctctttttctttattagtcttgctagcggtctatcaattttgttgatcctttcaaaaaaccagctcctggattcattgatttttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgcgtcccagagattctggtatgttgtgtctttgttctcgttggtttcaaagaacatctttatttctgccttcatttcgttatgtacccagtagtcattcaggagcaggttgttcagtttccatgtagttgagcggctttgagtgagattattaatcctgagttctagtttgattgcactgtggtcggagagatagtttgttataatttctgttcttttacatttgctgaggagagttttacttccaactatgtggtcaattttggaataggtgtggtgtggtgctgaaaaaaatgtatattctgttgatttggggtggagagttctgtagatgtctattaggtccgcttggtgcagagctgagttcaattcctgggtatccttgttgactttctgtctcgttgatctgtctaatgttgacagtggggtgttaaagtctcccattattaatgtgtgggagtctaagtctctttgtaggtcactcaggacttgctttatgaatctgggtgctcctgtattgggtgcatatatgtttaggatagttagctcctcttgttgaattgatccctttaccattatgtaatggccttctttgtctcttttgatctttgttggtttaacgtctgttttatcagagactaggattgcaacccctgcctttttttgttttccatttgcttggtagatcttcctccatccttttattttgagcctgtgtgtgtctctgcacatgagatgggtttcctgaatacagcacactgatgggtcttgactctttatccaacttgccagtctgtgtcttttaattgcagaatttagtccatttacatttaaagttaatactgttatgtgtgaatttgatcctgtcattatgatgttagctggtgattttgctcattagttgatgcagtttcttcctagtcttgatggtctttacattttggcatgattttgcagcggctggtaccggttgttcctttgcatgtttagtgcttccttcaggagctcttttagggcaggcctggtggtgacaaaatctctcagcatttgcttgtctgtaaagtattttatttctccttcacttatgaagcttagtttggctggatatgaaattctgggttgaaaattcttttctttaagaatgttgaatattggcccccactctcttctggcttgtagggtttctgccgagagatccgctgttagtctgatgggcttccctttgagggtaacccgacctttctctctggctgcccttaacattttttccttcatttcaactttggtgaatctgacaattacgtgtcttggagttgctcttctcgaggagtatctttgtggcgttctctgtatttcctgaatctgaacgttggcctgccttgctagattggggaagttctcctggataatatcctgcagagtgttttccaacttggttccattctccgcatcactttcaggtacaccaatcagacgtagatttggtcttttcacatagtcccatatttcttggaggctttgctcatttctttttattcgtttttctctaaacttcccttctcgcttcatttcattcatttcatcttccattgctgataccctttcttccagttgatcgcatcggctcctgaggcttctgcattcttcacgtagttctcgagccttggttttcagctccatcagctcctttaagcacttctctgtattggttattctagttatacattcttctaaatttttttcaaagttttcaacttctttgcctttggtttgaatgtcctcccgtagctcagagtaatttgatcgtctgaagccttcttctctcagctcgtcaaaatcattctccatccagctttgttccgttgctggtgaggaactgcgttctttggaggaggagaggcactctgcgttttagagtttccagtttttctgttctgttttttccccatctttgtggttttatctacttttggtctttgatgatggtgatgtacagatgggttttcggtgtggatgtcctttctgtttgttagttttccttctaacagacaggaccctcagctgcaggtctgttggaataccctgcagtgtgaggtgtcagtgtgcccctgctgggggtgcctcccagttaggctgctcgggggtcaggggtcagggaccacttgaggaggcagtctgccgttctcagatctccagctgcgtgctgggagaaccactgctctcttcaaagctgtcagacagggacatttaagtctgcagaggttactgctgtctttttgtttgtctgtgccctgcccccagaggtggagcctacagaggcaagcaggcctccttgagctgtggtgggctccacccagttcgagcttcccggctgctttgtttacctaagcaagcctgggcaatggcgggctcccctcccccagcctcgctgccgccttgcagtttgatctcagactgctgtgctagcaatcagcgcgattccgtgggcgtaggaccctccgagccaggtgtgggatatagtctcgtggtgcgccgtttcttaagccggtctgaaaagcgcaatattcgggtgggagtgacccgattttccaggtgcgtctgtcacccctttctttgactcagaaagggaactccctgaccccttgcgcttcccaggtgaggcaatgcctcgccctgcttcggctcgcgcacggtgcacgcacccactggcctgcgcccactgtctggcactccctagtgagatgaacccggtatctcagatggaaatgcggaaatcacccgtcttctgcgtcgctcacgctgggagctgtagaccggagctgttcctattcggccatcttggctcccacctcccgaactcatccttttttatggctgcatagtattccatggtgtatatgtgccacattttctttatccagtctatcgttgatggacattttggttggttccaagtctttgctattgtaaatagtgctacagtaaacatatgtgtgcatgtgtctttacagtagaatgatttataatcctttgggtatattcccagtaatgggattgctgggtcaaatggtatttctagttctatatccttgcagaatctcctcactgtcttccacaacggttgaactaacactctcaccaacagtgtaaaagcgtgcctatttctccgcatcctcgccagcatctgttgttgccagactttttaatgatcaccatcccaactggtgtgagatggtatctcattgtggttttgatttgcatttctctaatgaccagtgatgatgagctttttttttttttttcatatgtttgttggccacatacatgtcttgttttgagaagtgtctgttcatatcctttgcccactttttgatggggttgtttttcttttttttctggtaaatttgtttaagttccttgtagattctggatattagacctttgtcagatggatagattcagatcagagctttaacagccagactttacagggaaaaggctgagtggcacctcctttatatgaagaaaatgttcttctccaacccacttgtgttcagtggatggaagaagctgttcagtaattataactgacacttgtaacacataactgattgatttaatgcccataaattttattttctttaatcgtaagatgtgaccgttaaattcttagaagacatttggctagtggattaataattaaaagaatattggatgaattcatctgcttcctattcagcagttcttttatttataaggctatttttctcaaaatgaatgatcatgaatatctaagaaaaaacaaaatatttagctgtttgaagatgaaattattatcttttgatgttgttttctttaaagtgtttacaatgataactaagtggtagggcttcttccctctgttactctaagtatgcctcgtatacatcctcaaagcattttttttttttttttttttggagacagagtcttactcggttgcctaggctggagtgcagtggcatgatctcagctcactgcaacctctgtctcccaggtttaagcaattctcccgccttagcctcccaagtaggtgggattacaggcgtccgccaccatgcacggctaatttttgtatttttagtagagacggggtttcaccaagttagccaggctgctcttgaactcctgacctcgtgatccacccacctcggcctcccaaagtgctagattacagacgtgagccaccacgcctggccacctcgaagcatttgtaaaagagcaaggtgatggggttcattaggtgtttggtatttgaaattaaatacctctgttattgatgaagccatattttaaatattatcaccactaaactcagttaaatatttccactgttaactacaaggttcaaatgcttggatattatagaagatatttgacttcaaagataaacgctacaattttgggtcataacaaatagcttttagaaggggaaaaaataagtcttgggaggaaaataagcagtctcttagtttaatatagcggttggcaaatatagatgcttaaaagttctgaaaatccccattgcaggccatcagagtgttgtaattaagtattaaattaattcagataaaaggataatccatcagggccactaatgtagtggaagtgtggtttcggtgtgattagtctcaccatggaagtcaaagaaagtcccactcagaatgaacaatgaaagaatcatatttgtctctgggtattttgtcataggctcaattgcccagtgccagtgtgtaagccactggtaaaatcctgagcccttagtcatgtctacaggtagctggctgccttagacattttatgatgacgaaattgaattccacttctgataatggtaatccatcatgtctacctctttttttctcttaaaactacactgacggccaggcgcagtggctcccgcctcatcccagcactttgggaggccaaggcaggcagatcgcctgaggtcaggagtttgagaccagcctggccaacatggagaaactctgtctctactaaaaacataaaaactatccggtcatggtagtgtgtgcctgtaatcacagtactcgggactgaggcaggagaatcgcttgaacccaggaggcagaggttcgttgttctgaatgacatagccaggggtggttatttctaaattttctgtgttgaattaagataggaatgtggatttcttcctattttgaacaacgaccaaaaaaaaaaaacgaaggctaagtgtgtttcactctgctaaaaatgtaccttttcttgaatctgtcactttttcacttacattttctgaaaatgaatataattaaccaccatggggctcagcatgctggtggccatttggaggaacttttctaccaacagtgtaacagagaaaagagaaaagggtactacagcgtacctcaacctcccctgactgttctgtgaagtacaagtgtaagatttctcactgtgatcttttgctcctctgcctttttactgccaagggctaagatgggcacagggccctttccagctgcccctgcctgagaaatgcttatttgatgaccaaaagcaataaccattccataggactaacggtgattaagtcagcttacaaatccacaagggtggaagagactgctaaagatattggaacagacatgcttaataatgcctaatttctacagctacttttgtgataatacgagaggctgaaatagataggggctgaacatgggaaggctggtgttatgaagcccaggacttggatttcagcactggtgcttactggccattgggtcttgaagagattggttcctttctcccagcctcagtctccttgtcccatcagattaataatgcctgccttgggagaggagagtcatacaggagagggcatttgagctgggctctaaagagttcaaataacgtagatgagcagagatgggcttccaagatagcaggaatagaaaacaaaagtgtcagaatgggtatgcatggtcttttgtgggaataccccaagctatttagcctgagagagaggtgtggtgtagacagctggagctgtgagttccatggctagaaatacggggtgggcccagaccacagagggccttcagcatctggcaaaggagttggaattaattcggtagaaaatgaagacccactgaaacaaagagggagccattcttgtgtgtcaggaactaagatttcaggaaccaaacgtaaaataaaaaccagcagggagaccattgtctcagtcggtttgtgctgttatcatgataccagagactgggtaatttataaacaaacaatagaaatactacaattctggaggctgagaagcccaggatcaagccgggtgcagtggctcacgcctgtaatcccagcactttgggaagccgaggcgggcggatcacgaagtcaggagatggagaccatcctggctaacacggtgaaaccccgtctctactaaaactacaaaaaattagccgggcgtggtggcgggcgcctgtagtcccagctactcgggaggctgaggcaggagaatggcgtcaacccgggaggcggagcttgcagtgagccgagattgcgccactgcactccagcctgggcgacagagcaagactccgtctcaaaaaaaaaaaaaaaaaaaaaaggcgccttgtggctgcatcctccagaggcagcaaaaactgttctcacatggcagatgcacataaaggggcctgtgctggtttcctctagcccttttagaaggcagtagtccattcgggggcacggggtggaactgtcatgacttgatttccagaagaccccatctctcactactaccacagtggagatttaagtttcaacacatgactttgggggacattcagaccatagcaagcagtgaggagactatcgtaattatccaggcgaaaagtaatcatattcctaggggcggtgagggtggtgtggaaaagcaagcaggaaatggctgagagaattcagaaatagaatgcaaaaggatttgtcggtagtgtgagtactggacacgaagaaatacagggagtcctggatggctctgaaggattcaagcctgtgactgggagggagaatggttctgccatgattagaaaacaggaaaggtggaagggaaagccagggaccttgagtacagttgtgtacctaccaagtgcatggatcaggagggagccctaagttggtatctccagcaaactgttggaaatatacaaatttgagtgggagggagaagtcaaagctggggaagtacatttcagattcacccaaaggtaggagatctttagagtttcaagagtcgatgggatttccaaaggggagaattgtagaaagagatggaaagagatacaagaagaaaatgacagggatgaagagaggagaaaaaaagagtaaaaagagttattcagagatgtcacagggaagaagataagtactgtgtatgcgaaacagtgagaacatttccaaataaaggacatggtaagtgatagtagataccacagacccaagaacagcgtagcccctggggagttcaagagctttctcgctggcaaaggttatttcctgtcaagatgaatgtgtatgcaccaataattattagtattccagaatatcctctctttagcatagtaagtgcttaacagtcacaagcaaaagatttatataaaagaaatgctcatttaatttatttaatcagacattggctaagttattagccgctacctatggctttgtaaaacatgaaaaagttggaggaaatctaatgagggtcttttatctgtaagggaaaggtcatcatgggcatcaagtattgaattttagaaacggtgccacagtgaatagggatatattataactcagattagacttcaaaaggactaatttgcttgggacttccatcatttaaaatcacttgcaataaaactgactacatgaaaagatattaatcacaagctttaatgctattccatcaaattattttaatgggtatatttgaacagaattttaatttttcagatacattttttgtcaatagaaaagagaatttgaaagatgattgtaaaatgttacaaatcaaatttaaatcctgatcttattttcattttctctagcaataaaactaaccagtgatgtgtctgaaatatatactacagcaaactcttgacacagctatgattggaaaatgagacattttggttaatcaaatattattgttaatagtgcagtgctgtctgtcggtctctaatttgtaaaaatcagagaaaaacatggtgaatctttggtgacataagagaagactcacaaatcttcatatcctggggtcagtttttaaagcagtaattacacatgatacaagattatattctaagctctctttttccagtaagaaaagataagtcaatgatgttccataaagctgattcttgtttaatcaatttttaaagtgggggggtaggcggcactgacagcattctttggaaagggaagcaacagaggagaaaggcaggatatttggtgtctgctcacattgggaaatacggggagccaggggtggttaagtccagagaaggctggatgtctgtctgcagggctacatctggaagggcaagggaacagtttccttgttgcctcagagcataggtcatgcagcacaagaggagcatttaggaaatgcagattttttttcaaggcaagacagtgaaaactattcaagaaggtagcaaactactggccctttaatgcttttcttatccttgcaagtgtgcaaggcaagacaggagattgtctgttgtctttcagcttgaatgagattgtgcctcacttactgccgccacaccaaagcctggcgtttattcctgtgcgatcattgtatactagggacgtctaactgtgtcaggaggaaatggcagctgagcccctgtggcctttcacctctagcagtgccacgctgcagcacattggccggctgccatgctcctgcctgcagtcctgccagcagctcttgtgagctgcgactttgcataagtagcttgaatgccatgtgcctcagttttcacatctgtaaaagggagatgataatggtacctatgtcatggctctaaacgcgatcatgcacgtgaaagcagttgaagtcttgcctggcagaagtaaatggtggctgctgctgctgctgctgttgtgattgttgttactcaccaaagagatggttttgtttggtttagatgagctgcttcagaaagagcaaaactattcagatgacgtcttggccaacatgattagtgaaccaaggatcagttacggaaacgatgctctcatgccatctttgaccgaaacgaaaaccaccgtggagctccttcccgtgaatggagagttcagcctggacgatctccagccgtggcattcttttggggctgactctgtgccagccaacacagaaaacgaaggtaagagtcccctgagccagcaagggcgttctgggaggtatatatacacatacataacgtgtgtgcaagagagagagttatcttttgtatgttcttgagtggtgaattttttttgatgtagtcataaatattttcattataattttactttaaaaagtaaatactaggagttactatgtcattaaaataatatatctgtgtaaattattctttatattttttatgctgcaaagcatgtaaactgccaattgttggaaaagacaacaactccattgtataggtggcaaaacaaaatggtaatgatttacataacatttgcaggtaaagggcctcttgtttcgcacatgtccaggtttgcattctagggaatattatccttcgagtgaacactcccggacgaaggggagccacagtgtattattgaagaggcagttcttcacaaggaaaatgtgtggcaataacattcttctaatttttattttccagttcctcttcttaatataaaatggtacattatataacaaaagtggatacataaagagcatgtactgtatatcatattattatgtttatgactttttcaaatgaggaaatggaggcaccaggagactaagttcttaagtgatgacttttggtaggaattttttagaaatgttttttaactgtgaggtatattgttccctctggaatggaagcacaaaattcaacttgtgtttatgacgtaatgacctagaatgccaccttccaaaaaagcagatagatagtgaaataaggaaaaattacagtttaccaacagagaggagttttgagggcctgcagagatgcagatttgacaggcaccaaagtagtcttcactggctacttattcttacatgaaatttcagattgaattaaatgttaaaggcaaagatagagaactacatataaataaaatttaattttgcttaagacttaatttgtgtttagaaaattaaatttaaggcagctgccaaaattaaggagcacattgctctaaatgttttttcctttggtacctcagagaagtaagattcttctctatcaacaaatttgagcagtagatggcatcctttttcacagggatttcttagcagaaacacctgttcaggcaagaatatctttcagcttcttttatctttttctacatgttcagaagtatacaattacacacaaacaccttgatttctagatacaaataacatgttttttaagaacacaacagcactttacctgattttctttatcaaagcagcaaatgttgatggagatttcatatttataatataccttataggccaggcatcgtgggtcacgcctgtaatcgcaggacttagggaggctgaggtgggcagatcgcaaggtcaggagatcgagaccatcctggctaacatggtgaaaccccgtctgtactaaaaatacaaaaaaaagttagccgggcgtggtggcgggcacctgtagtcccagctactcgggaggctgaggcaggagaatggcatgaacccgggaggcggacgtggccagtgagctgagatcacaccactgcactccagcctgggtgacagagcgagactttaaatttaaaaaaaataaataaataaagtaaaaaatatatataccttataacatgcaattagtactaaatctaaatataatattagaccttaagtgtactggacaagttttttctaaagaaccattgcagaaaatatatagactattttcacaatgtgaatcatcaccccaaatttgtttccttaatttgaaaaagggcaccttacagtaatagcaaacagcatgttactgacaatgtaaaaataattaaaactttaccatttatgaaaataattcttaatcacatagaagaaaacaattttagggacagttcattatcaaagacctggaaaactgtcctgttaaatgtattgagtgcagattgttttgtttctttacaggtagatagattttggtcattgaaggtcctcttcattcagtctctaatgagaatttttagtgaaaaatgtccgatctcattttgtaaattgaatgcacgctaaatttgctcttttactaacagcataccttgttgcatcagccttaggagaaaatctgcgtgcacacgtgtgaatgtacacacacacacatacactgtgaacccttggtaattgccaggatgtccatttgagcaaagcccttgattaagtacttctggatacttgacaaacacgcagctattacattgcctaggtctcatgaaaagagctgatattcttgttggatgattctgtttgaacagtagaatctggtataacaattttgggaggcaatagaacttgcagtgtcagagtcttgagttgcagtactcttcattatcagtcccaacattgacatatatatattgattatagcaaacaatttaaaaagccacttaagcaatttttttttttttttttttttttgagacggagtctcgctctgtcgcccaggctggctggagtgcagtggcgcgatctcagctcactgcaaactctgcctcccaggttcatgccattttcttgcttcagcctcccgagtagctgggactataggtacccgccaccacgcccggctaattttttgtatttttactagagatagggtttcaccgtgttagccaggatggtctcgatctcctgacctcgtgatccgcccgcctcagcctcccaaagtgctgggattacaggcatgagccacggcgcccggccccaattggtttttaaataaaatagacggccatcatctcataggatattaaatactaccccatacccctgaactcctgaatgatacagacccgagtttaaattccagccctgctatgtgcttctgagcaagttacttagcctctctggctgcttcctcgtctgtaaaataaggttgacaataattcctaactcagaggtatagtatgagcattaaataagaaggcataaaaaagctcttagcaaaattcctggaacgtagtaaatgtcagtggtagctttttttttttttaatggagccaggatcttattagagagactttatcagcctgtctcaagatgaatcaccttatggcctcaacaatgtatccttaaaataatgaatataataagccatataatgagatacagtcctaaagccgtctctcttctaacaccgtctcccacctctccccagaaacttgttagtctttctttgtacagacatgtgcacacacacacacatacacccaactactgaaaatatctaaaattctcaaaggatttccttttgttcttcatgcagtcctcattatcatagtttcaaatgcttaccaaaaatttgttgtttttcttaagaacaatcagtgaaatccagaggaggttctgatgcccattttttaaatttacattgaagaaaataagcatatcagagttttccaatgtgctgtgatttgccttaacaattttttattctttggttttcacatccacaaaacctaaatgaatggctaggctgaaatgaagctgttgttacagaattgtgctcacagatcgtgaaatgatctggctggaagcattagcgttgatgacatttgtgtttgttctactttttcctgactgcctgagaagggcagccacaaagagcagcatagcatgcagtgactgccagcaagtctttgtggccaacagtctgcctctttgtagataatacctagatataatatgtagataaaataatatttttaaagagacaaagcaggtcttataagacttgtatggatgtatttgcaaaatgtgaagctgccttctagtatatttttaactagctttatagaggcaatgaggaagccaatttaaatgttgaaatttagattaaataaatatttcattaaacttacaaaccagttcttgtcagcctcttatctatatgtaaaactggtgtactgctgattcctcattacctttggcctggtagagagtttgtacaaggcagcacggttaatagttgaggtttattacaaagaataccagaagtaacagactcaaaaatcccagaggtctgaccattctgtttctctcctcttacagcaaaggatttgattcaaagctactgagagcaagagaataactcatttctgcttacattttattttaactctattaaaagttaaagctaagataatgtatttcttgtttttaaattactaaacagccaatgtaagatgttttttagcacttcattgatgaagttactgtctggttaagtaaaggtcaattggaaaaattggaaagtatttgcagtggattgggaaataacacactactttgttttgttggtgtgtattcttttttttcggcaatgatatcataattgccttttaaaaaacttttaatgtctgctccctgagctacttattttttgagcattaatttatactaaatcagcttcaatcttttaaagcagattagggtttatgtcactgaaactagttttgtttaatcttcctaaaaaatagggttagggttttattattgtttttaaataatacatgcctatttaaaaaaatagaagaagaagaagaagagcggggagaggcagagaaacttataggacaatatcatttgtaagtttctttcacataagtatacgcatttgaaccctggaaaaaccatttactttgtgacacaactgaagttcagaaagaatgtgattagccccagatcacagagaaagtaagtggtgacattagcagtggcccgtgggactaccagctcctcagcctgcatttaaaccacaggtacacttaacttactgccccgagttgcatatacattttctaataacgtaactattgatgtatgtgctcaccaccacttcaaggtacgcgtttgccctcgtgcatgtggtctgttgtgttcttaactgcagttgaagcactattgggtccctcatcatcaggaaattctcacaaagtacaatgacctttcaactaactgcattttacaaggagtaatacagttactcattacaggttgctgcaaataggaaaaaaaatgaagtatagaaaaaccaaacctcattgtcgaaatgtatttgggagttgcagaaggaagtgaactatgtcttcctctaatgcactagtgaaatactagagaatagtcactctcgcatcagtagttactatggaatatttaatcataggatatttaatcagtgcagttctgtagtatctggtagggtctcaaacaggctttaaaggttacttatttgttcctcaccataattagaagatgcagatgttaacatttctgtttccatatggagaaacagccacagaagtggcgcatcccaaggccacagacattgtaaatgttgggcccaggcctgggattagatgcctcaccctccttttgactccaccatgctgccagtctctacatgagaaaggaccaaatttttatttcatccaaatatcctagtgctcccggaaatattttcttatattttggagacttggcttactgccactttttttctccctcactgtttctattaacatgtggcatccaaaatcgatttggactgagaatcccacctttgaatgcctggcctgtgtgcatcagtaagctggatggttttgctgaaattgttagaagccatttcatcgagcacaccgtgtctccttcagcacctgtgctcactttgtcttacctttttccctttacacttgccaccttaccaaagcagcttccccctgcacctccactccatggcttcatttaccctatgaccattattaatcctaaaaacttcacttttgtccccattccttgtttcttcaaacgccagcgtaaaacaaggaagtattttctgagcatcagaagtgctttggaaaggtcagatgatggtgaggaatatcatgctgtccacactgctttctttgggtcggacccagaacacataaaaagggaaaattgtgaacaatggcaaatataaaatgaaatatcctcatttcacacgtttcagctgtatgtcatctgtcaaatggaagccagcctttttgaaaaagtgagaaaaagactgcggtttccctcttctgccctcatactaaggacaaatttgattcactcactaaatggcagattatatagtaaaactttgctctcctgataaattcatatttgcacttcccctggaaatttaacagagtccttttgtagttaattaactgtaaaataagataagattgggcagttgtaaaaggaagtatctttaaggttttctgctaggctgggaatattttatttctaatcaaaagccaagaaactatctctaaactagctcagagggaaatccaccctccccacccctcttctttgatgttgctgcgtatcctggtgagggcttttattagaaaactaaggagcaggactggcacatcaatagcgataagccatttaaagtggtgcccctcctggtcctcgatgctcgggattaactcactgtggttcttttctggctgctccttttttgtaacttgtttattgcatatgcttttttccctgctcgactatgtttgggagccacgacttaccatcttgatttgtcttgtttgctttctgtgtcccttgcttcctgtgcccagttgagcctgttgatgcccgccctgctgccgaccgaggactgaccactcgaccaggtatcagaaccgcttgacttgtgcctctccgcatcttgggcctaagctcgagcagacgttgtctcctttctgcattttaagcctctctcaattgtacttactgcagagtagaatttgaagtgaccttagaaaccaaacttttaaaaattccccttgactattccttactcttcatttcccaagttccgagtgaaatgattttttttgtttctgagctttccctttgaaacctaaaagagagcccttccaaatttgggtttttttttttcttttttctttaaaacaaacaaaacaaaacaaaaacagagacgattatatacagcctgtccttaaaaacagaagcccagatagatgtagactctcaggtgatgacttggataccagtgtgaacatctctcctttcttgtttggtgtccagatgggtaattttctaactgaactgggctcaaacttcaatcagttactgaagtagacatgatttcctgaaaataccagaattggtttctttccagagcccaaaatacatcttctgttttgtgggttgtatgtacttattctcaatgagtggctaaagtaacacaacagatgtggatgcataattttgcacataagccctttttttatgtattacttaaaaatcccattaacactgaaatagacacttctttttttacagtttcacaaacattaagaagaaacacatttttattttatgaataatgtcatagcacagcagaagcatatatgtgcctggtgtctactctatgaacaacctcacccaactgatagtagccagtgctttcagtgaatcaaaaagaggaagaaagttattgaattgacaaatttgtgtattccagggagattttaatcccaaataacacatacttttccatatttattttcttctttatcctcataatgtccccaggcgatagtcaaagaacagggaattaactttctttgaagatattaatacacagaggtcaacctttgctgcctggttcagatacagtcagcagcagagccaggagacccaccctgtccctcacacttccaccacaggctcgagccatgactgcctccaagcacggtcactgatgaagactgagagtctgcctgtggcatcttcatgcctttatgctgtgattaacagtggcagcagagacagtagtgtgacacgtcttgacagctggtctcgttgatttatgaatttctgtctgtaggcttttaaggggaacttaaattatagtgagtcagagacagtttcagttcttctaatgtcctccttattgtcaatgtcatgtaagggaatctcaaggagccaggagttgacattcctgttctgctcagccaacttgtaaggcctcgggctgagggtcagttcagttctaattgcaaccacagccagctcaggttggtcatttgccttgggacttttttcatggtgcttctctttaaaagacatgctcttcatctacaagcataaaatgtaacttagaaagcgctcattcgactcattcaattttatcaaatttctacattgggccaggagagcctatatgttactattgaaacatccaggaacaggtgacactaccagtcaatgtttttttcttttttaaaaaaattgttttttgattttttttttttttttttgagatggagtctcgctgtgtcccccaggctggagtggagtggcacgatctcaactcactgcaacctctgcctcgggggttcaagcaattcttgtgccccagcctctcaagtagctgggactacagatgcgccccaccatgcccagctaatttttttgtattttcagtagagacgggatttcaccatgttggccaggctggtctcgaactactgacctcaggtgatccacccacctcggcatcccaaagtgctgggattacaggcataagccaccatgcccggcctattcttttaaaaaaaattttttttaatctaaatctaacaaaaaggacacctccaaacgctgtcaaacaaaaacagtgtgttttaaaggaagagctagagaatagttaatggtattacactggtgggagaaaaccatccaaaacctttctcataacagtaagaatatgatgtcacttggggatttcacaaagatcaatccactaaattctttctaggtttgaaagaaattaaacggtagggtccctgctctcaggagcttgaggtataatagaaggaattttgcatatttggaaacatgagatggaatttggaagacaaggaaatacaaagcaacattaagtgctaacaagaatgttctgtgatgggaggagatggagtactaacccaggggcatgttaagtagagaacttactggagatgggcttccagagaggttatgaaagatttgaggcacctggattggcaaagaagaagggaacaattctattcagaagagagggtggcctaagccaagcttcctttcatacacagcgtaggcttgggttgcccagtaagatggctaaagttgagaaagaatgctcagatatgaagtgaggaagattctagttaaggtttgtctatgaatagcagtatttactgcacatgtattaagccatgcgtgtgttctgtttttgtgcttgtagtaagtttatcaaacatttgggctaatttccccgtgttttgtagcatagctttggttcttcttcacattttagagaccacccacttgagtctaatgtgccgaattatatctttagcctttccaaacttagaaagccttcccaagattgtcatgccgttcaagtgatggcattgtttttgaataatcactgttgtcctcagaaacaagttaaaaaaaggtttttgtttttcccccacccagtgctttataatcatgactgaggaaaatggcttctccttaactctcatatctaaaaaaacagaatatggtagcttccagcatgcagtgtcaagtagggaccattgtaataacagtggtgatttgggggcatagtggccattatagctcctcctcctggcttacttccaaagaaaaaatagactctgaaggactaattatacagtttgaccagaataaaaaagaaaaacacattagcgagctcttcacatagggtagaaagctaccctttctgttacaattcatcaccacccttctgcagtccaaataaagggaaaccaggtccttgacccgagccatgcaagaggtgtcatgaaggacatacctcccttagcccccacatgaacaaaaggctctgtccactcatcatgacttacaggaagagagagctggagtcaccagggcttagggtgaaatcagcacaactcaagaaagacctctaagtaagcctgcaaaccaaggtccctgccatttatttgaaactactcatcacattttattacatgcattatcaccttattatgaatatttccctatgtgccagcttactgattttttcttttagtaagatttgcttaatgtaaaaagtcttccctagatgactattcatgctaaacaaacatgaactattatagcaagagctcttctgccaagagcttctcaaactattgagctgtaaacatgaatttatctgtcatgctgacttgataatatgaatttttttttttggaccaccaaaagtattcacagtatcatttcaaaagtagtgtgggcttgtaaagtttttagtggagagctcttggttttgttttttttttttttttttttttgaaacaggatttgtctctgtttccaggctggagtacagtggcatgatatcagctcactgcaacccccacttcctgggctcaagctatcctcccacctcagcttcccatgcagctgggattacagggatgtgccaccacacctggctcatttttgtatttttagtagagacagagttttgccatattggctaggctggtctcgaactcctgagttcaaactgtttgcccgcctcagcctcccaaagggctgggattacaggcatgagtcactgcacctggccgagagctcattcttttttttttgagatggagtctcactctgtcgcccaggctggagtgcagtggcacgatctcggctcactgcaagctctgcctcctgggttcacaccattctcctgcctcagcctctagtagctgggactacaggtgcctgccaccacgtccggctaattttttgtatttttagtagagacggggtttcaccatggtcttgatctcttgacctcgtgatcctcccgcctcggcctcccaaagtgctgggattacaggtgtgagccactgtgcccggccagagctcattctttacttttatttttcagtataaatatttggctccaaaatctaaaagggaagactcttcaaactgttcaagaaagttttcttaaaaatctcagaaatatagttctaacctattgtgttgctagatcttttatttatttatttatttttggagacagagtctcattctgtcacccaggctggagtgcagtggcacaatctcagctcactgcaacctccacctgccgggttcaagcgattcttatgcctcagccttctggagtagctgggattacaggcacccgccaccacacctggctaatttttttttttttttttttttttttttttttgtatttttagtagagacagggtttcaccatgttgaccaggctggtctcaaactcctgacctcaagtgatccacccagcttggcctcccaaagtgctgggattacaggcgtgagccaccgtgcttggcacgttgccagatcttaataacagaaaaggagtgagctctaaagaaatcactggttatataaggatctcagatttaaaagggctatagaaagattaaaatatacagccagtgagaattaagagagttttagcatcactaccctataaaaataagtgtcagaaaggttcgtttcagcagaatgagttgaaacttaaccaaaaaatacttaacaatattaaagtaagaaaataaataagaatagagaactctgtgggtctcgtagcaagaagttgggggttgagggttaggtcattgagaggaccagagttaaagaatgagaaagggaaactgtcccacttccattgtgccttttatgtctatattaaagagaatgaacttctgatgaaaggaaattaaagcccgagatagatcaacatgagaaaagaaagccctagcccattagttacctattgctacgtagcaaataacgcgagaatttagcagcttaaaacaacaagcattagtttcttacagtttttataggtcaggatttgggatgtggtttagctggatggttctggcacagtgtccgtcatgtggttgcagttaagacactgcctgagctaaagtcatctgaaggtttgattggacctggtgggtctgtttccaacgtggctcactcacgtcactgttactaagagacctcagtatcttaccatgtgaactctgtaatgctgcttgagcgtccctacaacatggcatctcgcacccctgcaccaagaggtccaggaaagagattaaggaagttttagtgccttttttggcccagtctcagaagtcatacaccatcacttctatcatgctctgttcactagagcaagtcactacatcccgaccacattcgaaggaagggaatcaagttctccctcttgaaggaaggagtatcagcaaatttgtggatatattttaaactatgacatcttgctacccaagtccaagttcttatgacccagaccaactgcaggctaagagaacttgaaggggaagtagcaccattgcctgtggtctttgtggaaagctgggaaggtagggataggaaaatgaagttctgaatagcaaaaaggagagaagatagcttcacaatctgtaagccaggtatagagtgacattgattgtgggtctcttttcaaataggttatcaagtggaagctttttgaacaattggatgaggaaatggtgctaggtcacaaccagcgtggatttcctaggttttgtcagattatccttaccttctccttgtataggctgtgctcttagactggcacatcatatgctgtggacattgtgcttttcagtgtcagcaagatgtgtcacaagtttcccagaatctcgtagacaagattgaaagagtgattaggccaagagcaggaagtgaattcccctgggagccaaaggaattgggaatgtgtagcccaagtaagacaagaaccagcaggaacatgcctctccttagggtcgtgatacctgttcaaggttttaatgtggaagggaggattaggcttgctctgtgttgaatcaggctcaaaggatggaagttacagggaagctgattctggcttcatgtaaaaaaaggacagtttgggcaggcaaatctatcaaaaaatggagggaaattgatacattcctctatgttcaaacaggaactgacaatctgcccctgggtgggaacacggtagagaagatgacttcaaaagcccttttcatcctaaaattctgatgtttgataattaaatgttatagcatggacactgacatttacattttttacttatgtttttggtttttaaatgactctgcattttgttttaagcttcaaattattatttgaataatgaaattcatcagaacaattagtgttaagaatcatatagcaatttatagaaaaggaagagttcgtaggttataaattctgttagttgctaagaagcatttttaaaattatgtactatagctctttattcagcagacgaaccaattacaatctgtgtaactagaacacttgactaaaattatataatttttacaacgcttcactgcatagatacatgaacataatttatttgtaattggaacaaagccccaaagtagcagttttgttctaccaggtaattaatgctcatttttaaagccttttattattatttctgaagtaatgagtgcacatggaaaaagacacataataggctaaacaataagcccgtaagccaagccaacatattccaggaacaaatccttgccaacctctcaaccaggatttaacttctgcttttcccccattttcaaaaattatagcatgtatttaaaggcagcagaagccttactttcaggtttcccttaccctttcatttctttttgttcaaaataggtagtaattgaagttttaaatatagggtatcatttttctttaagagtcatttatcaattttcttctaacttcaggcctagaaagaagttttgggtaggctttgtcttacagtgttattatttatgagtaaaactaattggttgtcctgcatactttaattatgatgtaatacaggttctgggttgacaaatatcaagacggaggagatctctgaagtgaagatggatgcagaattccgacatgactcaggatatgaagttcatcatcaaaaattggtacgtaaaataatttacctctttccactactgtttgtcttgccaaatgacctattaactctggttcatcctgtgctagaaatcaaattaaggaaaagataaaaatacaatgcttgcctataggattaccatgaaaacatgaagaaaataaataggctaggctgagcgcagtggctcaagcctgtaatcccagcactttgggaggccaaggcgggtggatcacgaggtcagaaattcgagaccagcctggccaatatggtgaaaccccatctctactaaaaatacaaaaaagattagctgggtgtggtggcaaacacctgtagtcccagctgctggggaggctgacgcaggagacttgcttgaacccaggaggtggaggttgcagtgagctgagatcgtgcctaggcgacagagcgagactccatcccaaaaaaaaaaaagaaaagaaagaggctgtatgtatagttctttcagactacaaggcagcaaagttcgtgcatgactcgggacttaaagtggaattaatttcaatatagcagccactttgacttccactgtgttttctgggaaaataggtttacaataggtttatttgaaggatcaaacacatgcatacactgcttggttttacagaacactttatgtggcttaaattcacatccggaactgtcttcctttacccattcatttctcccccagctctttcttttcattccctcccctacctcccatgatttaacttctcttgcaagagtaagatcatggagtgagcaggaccccatgatgttcccgatagtgttattcatcaaaaggtttgtgcaaagaagacagcagcttccttttcagatgaaatcacttttcccccctaatgttagaattggagtaaatcaaaaagccacatctcctttgtggtcagctctagtagttatataaaatcctttaccaaaagcttagaaatggagataaatcaaatcgtggattatgttagggttccatcttatcagtaggtgcagtaagagggttaaattaatgaagacgacaattttatcacattcagtggtggacagaaaaatggtaagaaaatttccatagcaataatacttaaagttatctcaggcacttcttttgttttgttttgtgtgtgtgtgtgtgtgagtgttacttttttccaagcagaaaatgtcttttcaatattcataaagttgataaatcctagtattaatctctaaaagaaacacctccaaattattatttatgccttacttgactccaaataattgtagcaaataaaaaactgacttgggatttggatttgcattcttaactcccatagttctttttttgtagaaagacatttagctttttgaagcatggttttcattggcaagataatctagtatcagttgttataagatcagggtttctcttgatgaggctgttgctgaagaggttaataaaaactggggaaccactaaagagttgaagagttggtggggtagaaagctgacgattaatgtacagatttgcatttgtcggggcctggggcctgtgtcatataagcccatccccacaattacactaacgcctataatgcgacagtgactaatggcagcggcagcaattaggagaatcagctccctctactggactagttaagataatgtattataattagtgcaatgaatattacaaaattacagtattttcttaaaggcacaggcatatgtccagacttgtatttattcctgattacctcacactagtatattagctaattaatgatttgcttttcataaaaatgttgagctagcatatttgtttagtaaagggaataattatgaacaatttctcattttgttataaaccacgagtaaaacacttttagaagttgcttcatttgctatattttatattgcctttccagattgctagtatgttagtttcagcttagaaaaatcagtcatttgactaccttgaggctaaattgaaagaattttttagggaggtacaggcataccttggaaatttcagaacaccacaataaaacaaattttgcaacaaaatgtcacacaaattttttggcttcccagtacatataaaagttatgttggccaggcacggtggctcatgcctgtaatcccagcactttgggaggccaaggcaggtggatcacaaggtcaggaggtcgagagcatcctggccaacatggtgaaatgccatctctactaaaaatacaaaaattagctgcatatggtggcatgtgcctgtagtcccagctactcgggaggctgaggcaagagaatctcttgatcccaggaggcagaggttgcagtgagccgagatcgcactccagcctgggcaacaagagcaagactctgtctcaaaaaaaaaaaaaagtttgtatttacactatactctagtctgttacatgtgcaatagcattatgtctaaaaaaaaaaaaagccatgtatatactttacttttattagtaaaatattttattactaaaaatgctaatgatcatctgagtcttcagcaagtcctaatctttttgctcgtggagaatcttgccttgatgttcactgctgcaggctaatccaggtggtggctgctgaggtttgtggtggctgtggcaatttcctaaaataagacaataatgaagtttgctgcatcgattgactcttcctttcacaaaaagatgtctctgtagcatgtgatgctgtttgatagcattttgctcacagtagaacagctttcaaaattggagtcagtcttcgcaaatctagccactgcttcatcgagtttatgtgatatcctaaatcctttgttgtcatttcaacagtgttcatagcatcttcaccaagagtagattccattgcaagaaaccactttctttgctcatccataagaggtaactcctcatccattcaagtttgatcatgagatggtagcagttcagtcatgtctttaggctccacttctaattctagttctcttgttatttccaccacatctgctgtgacatcctttactgaagtcttgaactcctcaaagtcacccatgagagttggaatcattgtcttccaaactcccgttattgctgatgttttgatctcccatggatcacagatgttcttaatggcatctggaatggtgaatcctttttagaaggtttgcagtttactttgcccagatccattagaggaatcgctatctatggcagtgaatagccctacaaaatatatttgaaatatattttgaaataataagaggctgaaataataagacttgaaagttgatccacaggctgcagaatggatgttgtgttagcaggcatgaaaacaacagtaatctccctgtacctgtccttcagagctcttgggtgactaggtgctttgttagtgagcagtaatattttgaaatgagtcttttctgagcagtaggtctcaacagtgggtttaaaatattcagtaaaccatgctgttaagagatgtgctgtcatcccagttttgttccatttatagagcatgggcacagtagatttagaataattcttaagcgccctaggacttttacaatggtcagtcttggcttcaaaaacaaagtcgccagctgcattagcccctaacaagagagtcagcttgttctttgaagctttgaaggcaggacttctctctagtgatgaaagtcctagatggcattttcttccaaataagtctgtttcatctccactgaaaatctgttatttagtgtagccaccttcatcaggagtcttatctagatcttctggataacttattgcagcttctacatcagcacttgctgcttcaccttgcacttctgtgttatggagatggcttcttcccttaaacctcatgaaatcaacctctcccaacttttttttcttctgcagcttcttcacctctctcatccttcatagaattgaagacagttgtgggccttgttcttgattaggctttggcctaagagaatgttgtggttggtttgatcttccatccagacaactaaaagttttctccgtatcagcaataaggctgttttgctttatcatttgtgtgctcactggagtagcacttttaatctccttcaagagcttttctttgcattcacaacttggctaactggcacaagaatcttggctttcaatatgccttgctcactaagcttaattatttctagcttttgctttaaagtgagagacctgtgactcttcctttcacttgaatacttaagaggccactgtagggttatttactggcccactttcaatattgttgtctctcaagggatagggagcctgggagttgagggggtggagtggccagtttggggggcagacagaacacacacaacatttattgatttagtttgctgtctttatgggcatgtttcatgacactccaaaacaattaaaatagtaacatcaaaggccactgatcacagatcaccgaacagatataataatttttaatgtttgaatatttaaataattaccaaaatgtgacacagacatgaagtgaacctgtgttcactgttggaaaaatggcaccaatagacttgttcgatgcagggttaccagaaacctttgttgttttttttttttaaatactatctgtaagcactactgtacaataaagctatgtatgcctgtattttcattaagttgcagagcaaacgtggtaatatttagctttagttttacttcatctggcataagatcaactccttatataacaagatgataaaagttgtggtgtgcttctataatttcattcaagtagataaagttgaaaaataatgacttgcttttataaacagtatgaagcaatgtagtgcagtaaatgaaattttattccttctttacaatgttctcaaaattatttttatgtttaatccaaataaagagcaagaataaagcaacatttcagattttggtttctggagacaatagttagaaagcatgagttatgagtgacttaaaattcttgttgcctgtacttcactttgaaataacattatgctttaaaaagcattacactgctaaaggttaattagaattctgcagaattactatagctaaaagtaggtaacaagatatctttttttctattgtttaactcctttgtttcagaatgcctattcctgtgcattaaaagtgtccctccaaggaaattaggacatctgcagagttgaaaaacacctaagtctcagtcacttagagtcacacatcagggctcagagtgctatgactaggaaaatgctgacctcctttcattagtatgatcgtgcctttccagcttttgatagatccaagcgctatcttcccaccactcaccaaatgttccacctgtcaaagggtttcaggtccctgcagacttcggttttgacctgtggggaaagtagacttcctcgaactggggaagccacatgttgtacatccttctataaactatgattatcattcttagtaggaaaatatgtgatttctttttttttttttttttttaaagtaagcatcaaatatttgaccaaccagttgggcagagaatatactgaaactttttatataacctcatccaaatgtcccctgcatttaagaaatgaaattcttctaattgcgtttataaattgtaaattatattgcatttagaaattaaaattctttttcttaatttgttttcaaggtgttctttgcagaagatgtgggttcaaacaaaggtgcaatcattggactcatggtgggcggtgttgtcatagcgacagtgatcgtcatcaccttggtgatgctgaagaagaaacagtacacatccattcatcatggtgtggtggaggtaggtaaacttgactgcatgtttccaagtgggaattaagactatgagagaattaggcttagctttttgctaagaactagctaagtatctcttttaaaaaacgaatcagtgtgcttccatgatgcttgggttacagttgttctttcttgttttggttttcattcattgcaacttaccgtgaatattctgctcaaggtattgagagtgtgtgttgttatctcaacttacaatttgtgttgaagttatcaaaataatacaaatgataatgcatgactttaaaaaagcatgattactcttagacttttttttttcaaacacaagcaacaaaaaccagtacaagaagttaaaaataaaaatagaagtaggaagttgctttttccaaaaaaactaaacatgtttattcttggatttcttttgtcttaaatagtctggcctctcaatacaaccaggtaatagtaaataatgtgacttttcagtgcagactcttacctttaaagtttctcaggaaatcacactataccaaatggcccaccaaaacatacatgattgttatttgagagttctgcaacctattaccctgcacttccacctgaaatatcttagtttcaaggtgctatactaaaacaagaaagagagaaagaaaatttacgaataagttatttttatgcatttgaaatgccatttggatgggggaaaaagtgttaaaatctcacagtatatgcaactttttaggaaactgtcttgcagagagtatagtgtaaacataacttttatatgcacagggaaactgaaaaatttgtgtgacatttaattgcgatattttaagagttatggaatttttagagctgaaagatttattgatgatgaccaatcaaattgatcttctcatcttgtagatgagggaactgaggccgagacagaagggttcaaattatgcaaggtcaagctcagagtccagatttcccctcatattccccattgctttttttttttttttttgagacagtctcgcgctgttgcccaggctggatcttggctcactgcaacctctgcctcctgggttcaagcaattctcttgtctcagcttcctgagtagctgggactatgggcacacgccaccatgcccggctaatttttgtttttagtagagacagggtttcaccatattggtcaggctggtctcgaactcctgacctcaggtgatccacccgccttggcttcccaaagtgctgggattacaggcgtgagccaccgcgtctggcccccattgctttttccatcagagaaaagtccaggtgtttctagggagttgaagattccactatccccaaggaaatgggctctaaaccattcttgattagaagaggacaggcagagtttaaataaatgaaatttgtggtgaagccagaaatttcattttgctcagcaattaaaacctctgcagactacaacagaagctgctgatggaaattggggtggagcctcatttccccattcatactgacgtggatgagcagtgtgaggaaggaaaccaagagaacagcaggcagcagggtggaaaggaacggactgacccatagatcagagtgtgagcacataaaagcaatgaccccactgtcatgtttggccattgcaccttttgtgatagtatctaagcttatgtccctcaaaacagtgtaagataggttttcattagtatcagcttatttcatttctgctcaaattaatttttaaaaaaatttaattccatatttgagcaaataaagatgtcttcatacttgagtaattcaagaccccttttttgctgctgttgttgttttggtttttttcatggttttgttgttttcttttgttgttgttgtttctttgttttttgagatggagtcttgctctttcacccaggctggagtgcagtggcatgatctccgctcactgcaacctccacctcccaggttcaagcgattctcctacctcactctcagcctcctgagtaactgggattacaggggcataccaccacgcctggctaatttttgtatttttagtagagacagggttttgccatgttggccaggctggtcttgaattcctggcctcaagtgatccgccctccccaacctcccaaggtgctgggattacaggcatgagccaccatgcctggccttcaagagcactttttagtttatttaatataattctctttgttgccggtctgtccgttgaagttgccttctttgatgccagaggccaaagacttggcttcctcgggcttccataacaaagtaacacagatgggtggattaagcaacagaaatttaccctctcacatttctggagtgtaagatcaaggtatcagccaggttggttcctccccaggcatctctccttggtttgcagatgcctgtctgctccctgtatcttcacatgaccttcactctgtttttctgctgtgtcctaacctcttcctacaaggacaccagtcatagtggattaggatcaaccctgatgaccttgtttaactttaataacctcttcgaccctatctgcaaatacagtcacaggtggaggtactggcagcttaggacttcaacatatgaattctagggggacacgttttagcccgtaacagaccccagtgatgctgagcataaaagcaaggcctccacctggagctccttcccctggctgtgcgtgagaccaggtcctacctcagacctaaggaaaaagaatccccaaataggaggctgcgaatctgagtgttgaaaatttccccaaatgaatgagatgtgcagtcggatttgagaatccctgacacatcattttaacactccttccttttagttctccgcgcaagcctcagggagtggaaaatggtatctctcacctcccagataaccggttgccttttaagtgctcttccagctgcctgaattaaaacgctctttttttagtcagtttaccaagcagtgtctcattggacttaaaatgtcagaggagaagttgacactttgacccagattctgacattaatttttaagccaggaggtatccttgcaggagcaaaatcgggaaggatggctgttcagctcttctctcctcattttgctgtctactggagagcaactggaagcctttctagatgaggggctccacctcattcgtgtttgttttgtttatttcctctcagctccttcccctcaagacctttgtgactgtccttcctgaaagcagccctctgtgcagccccatagtgtgtctgtacagcaatgttgaaatagaccacattccgcttttctgtcctcaaaaaagatgtagtttagctgggatggtagaacctgaacacagggagttgcaacccagcctagggatgttcccaggtgagagagcacggtgggctttcagagcaccatttttcttagcattccagcgtctgcacccacagaagtgatgcttctgcaacatcctcttcctaccttaacaggcactctcaccctcaagtacatggaaatacctttatttccggctctggctaaccttcattaatcagtaaccctacttcagtaagaacaaaaatgagtacatcaatatttccagttggactcacctcagtcactcaggacagaataccattgtacttacataccatcgtgcctgaagaagtcatgatgaaagctttggtttccaggagattttttgtttttagagtgaaaaatgcccgcagaagatcacagagataggaaccctaggaaaaaaactcctgagaacaaatgtataaatgaaacaagcctagaacagtcacataccacttcacactggagagaacgttctgagaaatgtggcatggggcggtttgatcgctgtgcaaacatcataaagtacatgtacataaatctagatggtatagcctgctacacacctgggctacacacctacaactattgctcctaggctccacacctgtgcagcatattgctgcactgaatactatagacagttgtaacacactggcagggatttgcgtatctaaacaaactagaaaaggtacagtaaaaaatacggtattatggggccaccatcatatgtttggtctgtcgtggactaaaatgtcattatgtggcccataactgtatttttattggtagagttgttagcatttggaaatgagcacttgctagttgttgtttttttttttttttttttttttcaaataagcaggaaatattgacttactgaatttacttagccataaggccagagagtcactctgtgagccattggccacgctttcccaaggaggtaactgtgccttattggtgcttcaagcagtgaagcaatagccctttattattaccactccccaaatgtgccctccatgtcagaatagccctctggtggctggaaatctcagcactagctgaattaaccaccttgctcctgttttaggacgttcctgcaaagcccactaatcccaggatctgtttagtagcaagcggtacttttctacattcacatacatagacactggatatttaaaaatacgtattgtagctctttctgctactctccccagacatgtcacctttaataaggagaagttgggggcacagcttctctttattataggatgtgaaaaagttttcctctcacagatctgatcacttgaacaccagaagtctccccgcccccacctcctggttatctcattaatgatctaaataagaagagagttccttttatttggcttttatggaggtatggcatatgactttttctaagtaatatgctgtcacactggtgactgtataaaaagatgtccttagaggtcctttcttcccggccagaagctgacccaccaggatacagacgcactgacgttggcattgtagagtagttggagagagtggtcaggttgaatggaaagccacgataaggaaaagtgagggggggtgcagaacctaggagtggcttacagtgagcagcaggaagagaaattggaagatcaaaggaaagcatcaaaaatgatcacaggccaggcgtggtggctcacacctgtaatcccagcatttggggaggccaaggcaggtggatcacttgaggctaggagttcgagtccagcctggccaacatggtgagaccctgtctctaataaaaatacaaaaaattagccaggcgtggtggcatgcgcctgtagtcgcagctactcaggaggctgaggcaggagaatcgcttgaacccaggagatggaggctgcagtgagccaaaatcacgccactgcactccagcctgggtgacagagcaagactgtcttaaaaaaaaaaaaaattatgaagggatagcaaaggagttcctgaacctgcctgaagaattgcttgatgttggccataaacatagtcaactgccttctagttatatataactatagagagatggcatcaaaattaggaaaacaagcatctatacaactaggtagcaggcagttactgggaggttacgagggataagtcactagcttgaaaacttcctattttctttgcttttattttttttttccgcagacttgtggctcctttgatgtgtcacactattgttgtattgttcgccttagttcccttaccctcctttactcgtctggtccatctcaatgacaggattctgtcgtttggcctgactcagtcccttgtataaaaggacatctattaatccacatcctgctggttactgtacataataaaatgtaaacgtggtgtttcctgcctctcctccaagctcacacacccgcatgtaaatactctaggggcaataggaggagacctagaaactaaggtcacccaaatagaatcttgtccctgcaggcggatagctgagctctaaattactctggatacagtgaaggactaaatggttccaatgaatcaagttcagggagaaaagggtcagggggtatggaggttagccaaagagtgtcaaacgttctcctcaaagctattttagaacaaggctggtcaggctatttgggctcagctcttttcagcgtgtgtcataggcagcagccagttgaagccatgccaccatgcagtgcaggggtccaggtctcaggaaggtgcagcgtaccgagagtcacatgaagacctcagatcatttcctgctgctgtgtaatccaggcagtctgggaagagaatgaatattcagtggttgtatgtatgtgtgtcttcatcccagcaagtgacagatgttcctgcccagttggaaaatggaaattctgacttcattgtcttatcattccttccagaacaagcaccatgggctcaaaccctccctggctctgctttaagggaaataatattgtgtctgtgcagaggccctgtctgcacagggtcgtggtagggctggccttcacatggtggcccatgccactgctgtagcttagccatgaggaagagattggtgagcctgctggagaggaaggctacccttacttggtgctcctcctttatccatagacatgagtactcagattttcgcatctagctttcaaggggctggagattaaagatccaatccatactccttggatgcccttttgtcaagataatcccttcttctgtagctcctaagccctctaaggtctgagggccaagctgccccatggcaggaatggcaaaatgtagctgtcctctcagtggcaaaaggtaataggattatcaagtagcaaaacagaagccaagaaaagacaggagagttagaggtctggattgtgcaccagccttggagcctcgcatctctagcagggcactcttaagcgttaggctttggagtttgaagaggagataaacctatcaaattgccaggtgttcccctgcccttgatgcatgcaaatgattgttgacagccagtgtgatggtagatgtgcctcctggaagaaataaaagtataatattccaacaatcaagcagcattgtggcttttttctacaatcagaaacatagcagctttgtgcttgatctcctaagcaagataattttttttaacctgggcattctttgagttctcagtttcgaggtgatggggagcaaaaatgatgcccaagttcaaatggcgtactgctgcagataggctgtctcctggcacacagatttacagagtgaatgaaatctctcattattggtgctaatctttaaccatggtttttaacttacaagttggaggctaattacacagttaccagttaaagccaggtgacctcatttgttgacaacagtgcacagcaaaggaaagaggagaggataaggaaaatatctgtgatttgctcccagaaggacagtgaagctgagcatccatttgagcagagtcctctgagtactggccttggtcagagcttgttggtgggagtgtgctaaggggagatgcctaggtctgtcattggagtaagctgagggtttggatgcaggggaactcaggcagctctgagccacagggtggtagatgggagggattcacagtggcgcacagtctcttccataaatggaaacgtaagaatcggggcacatggccatggcggctcatgcctgtagtcctagtgctactttaggaggccgaggtaggcggatcacctgaggtcagtttgagaccagcatggccaacatggtgaaaccccatctctactaaaaatacaaaaattagccaggcgtagtggcgggtgcctgtaatcccagctactcgggaggctgaggcaggagaatcacttgaacctgggaggcagaggttgcagtgagccgagattgcctgggcaacaagagcaagactccaactcaaaaaaaatgggcacataatggatggaacattctgtcccaagggatgagggagctgtatatctacctattccagctgccttgggattagccactggtagtcattccacctcactcccagactgaaaagagtcaatcacttcatgaagtggggctatccgaagggaccacaggggacctgattatactgacagatttatttttatttatttactttttttgagacagagtctccctctgttgcccaggccggagtgcagtggcacgatcttggctcactgcagcctcagcctcctgggttcaagcagttcttctgcctcagcctctggagtagctgggactacaggcacgtgctactgtgcctggctaaatttttttgtatttttgttaaagatggggtttcactatgttggccaggcgtgtctcaaactcccgacctcgtgatccacccgccttggcctcccaaaagggctgggattttgagccacctcacctggccttttttttcttggagatggagtctcactctgtctcccaggctggagtgcagtggcacaatcttggctcactgcaaactccaccccccaagttcaagccattctcctgcctccgcctgtggagcagctgggattacaggcgtgcaccaccacgcctggctaatttttgtatttttagtagagacaaggtttcaccatgttggccaggctggtctcaaactcctgacctcaagtgacgcacccacctcaggctcccaaagtgctgggattacaggagtgagccactgcacccggccatattgacagatcttttagtctgaattgttatcagccagtgtggtctagtcatgacatatctagctccatctcgagacctcatgtcttactgctgacactacatcctcgctggtactttttcttccttggcttcaggggcattgctgtgtaggctcagatccatgccagatggggtgtgtagggggaaaagctgcataagggaggaatgtcacttggcaacactcaacaagggggaatgggcctgcagtattctcccagagatgaatgagcagcccattctaggaaatatccctttgaaggaatatcttctctatggtacatccaaacttttctctggaaaacatgcctcttcattctgatgactttctatttattctcttcatcttaccatggttttacaaaagaggaattttaacatactcattcagcagagttaaggacctcctctcttctgcgaacggggagaggtataacaaatatagtaaaacaagaacagccactgcccacgttgtaggggtaagtaccctgcccaacctgcagacagtaaatgccacacacagctctaacagtgacagggggagaaaaacgtcttcagttactggcctgaccttagaggtaaagcaacatattaacagagagggtctgattttaaactttgagctgaacatacttctatagtatcttaattctcagtttttaaaaaattacatcatctagaatggcgtcgtccttgctcttccttttttcttgtgccaaataatagccccctttggtatatgttattgttttaattgattctcaaacctctccttaacattttaacaaacataaaatttgatagaaatgggctagactaaattcagcagtccaggaaatcgagtatttttctacacagatttgagtgtcacccaagatacagtatactttgctgaatctccctccatgatactcttgtggttttatctattttaccaaaacacttccacgtaaaacaggcttccgttgactctgtttgtcctttatggacccaacaggggaggaaaaaataccattgcactgggtttatccacttactgtggagttggggaaccagaaacaaccactggacacgttgcaagcgcgtcaaggtttccaccgccacctggtggctagatggagcacagcatctgtgtaactggtgggcaaaggcgttctgctccaagatgtcaaagtgggggagaaaattatgggtgttctgcaatcttggcaaaagaagagtactgtactccttatctttttactgcttctccatgttcacccttaaaagattgatttttattttttactcagctctcctcttgtttttcaggttgacgccgctgtcaccccagaggagcgccacctgtccaagatgcagcagaacggctacgaaaatccaacctacaagttctttgagcagatgcagaactagacccccgccacagcagcctctgaagttggacagcaaaaccattgcttcactacccatcggtgtccatttatagaataatgtgggaagaaacaaacccgttttatgatttactcattatcgccttttgacagctgtgctgtaacacaagtagatgcctgaacttgaattaatccacacatcagtaatgtattctatctctctttacattttggtctctatactacattattaatgggttttgtgtactgtaaagaatttagctgtatcaaactagtgcatgaatagattctctcctgattatttatcacatagccccttagccagttgtatattattcttgtggtttgtgacccaattaagtcctactttacatatgctttaagaatcgatgggggatgcttcatgtgaacgtgggagttcagctgcttctcttgcctaagtattcctttcctgatcactatgcattttaaagttaaacatttttaagtatttcagatgctttagagagattttttttccatgactgcattttactgtacagattgctgcttctgctatatttgtgatataggaattaagaggatacacacgtttgtttcttcgtgcctgttttatgtgcacacattaggcattgagacttcaagcttttctttttttgtccacgtatctttgggtctttgataaagaaaagaatccctgttcattgtaagcacttttacggggcgggtggggaggggtgctctgctggtcttcaattaccaagaattctccaaaacaattttctgcaggatgattgtacagaatcattgcttatgacatgatcgctttctacactgtattacataaataaattaaataaaataaccccgggcaagacttttctttgaaggatgactacagacattaaataatcgaagtaattttgggtggggagaagaggcagattcaattttctttaaccagtctgaagtttcatttatgatacaaaagaagatgaaaatggaagtggcaatataaggggatgaggaaggcatgcctggacaaacccttcttttaagatgtgtcttcaatttgtataaaatggtgttttcatgtaaataaatacattcttggaggagcaccattgtgctggtgtgaatgattccatagtaacaatcttgaccatttactgacgtacagaccagtgagaagtcttcgcatgttgggtacccacacctgttgtgtcttaattgcaagtctgagtaggaagttggggccaacatgtgtctcccagtgctgggaaaatatttcatagacctaatttacagtctttacttgatctaaaacattttgctgccatattttggccctcaagtttgtcccaaatgagagacaaagggaaaagttccagggaaataaaaattaagacagctgattatctgtaaagcatggtttctcatcctgaacgctactaacattttgcagggaataattccttgttgaagggagttgtcctgaccagtgtaggatatttatttattttatttatgttttttgagagtctcgctctgtcacccaggctggagtgcagtggcacaatctcggctcactgcactccagcctgggagacagacgagactccgtctcaataaataaataaataaataaataaataaataaaaggagggcctggcacgaatgacatgcagggaaggcagtgagcaggtggaggtccctgtactcgttgtggtgccttatctaccaggcggttgagttgacgtctttgtggacagaattcgattacaaaggtgtccgaaagtctccaggtgggggagagttttgtagcgggcataatttgggttgtaaattgactgttgtctcctgagcagtctcctggtgagggagagtttcactggagctttgaaacacatgttagacagccttgccctgtagggagtgtctcgtgaaggagaggtaaacaattataattgcatttctaaagggctaagtaggacatgggaaactggaaaatggagaaaagaagagaaaaaaatagtaactcattctctttttcttagaaaaatgaggatacttggtcacatcctcacatggtgaagaataagatggtctcttcatttcccttcaacactagtcccatcgtgaggctctgccctcatgacctaatctaatcctaactgcctcccaaaggtcccacctccacatcccattattggggattagggtttcaacatagggatttgggggaaacacaaacactcagttcatagtgatatctgactgcgattccaaaggtctgaggacacattggccctgttgtttttgctgtgttgtccttggcctcaggtgaacattttagctttagattgcaacattttaagctaaaaacactaagctagaaaattaaacttatctcgtcacattctgcatggtgaacaaactcaaaactcacctgagtgtatcttgttttcatgagaaaaaatgaccggtcatctcccttgccctgttagggacagttagacatgactgctgtatgaagatatgtacatgttaacaattcatatgtacaagctactgttccattttgcctggcccaaggggaggtagctagctagttggggtagcagggcgaattaaccctaatataatagtacatttctaatgccaccaatgaaatgaaaaccagctctcaaacatggcactatatgggatggcattccaaggccaactcagttacagtaactacagctttaactttgatcattttgttaccagaaaggggtcccaatccagaccccaagacagggttcttggatctcatgcaagaaagaattcaaggcgggtccatagaggaaaaggaaatgaagttttaaagaaagtaggaaaataaagagtggttgctccataggcagagtgaacctaagggctgctggttgcccattttattgttatttcttaattatttactaaacaagggctgaattattcatgcctccccttggtagaccatatagggtaacttcctgatgttgccatggcatttgtaaaccgtcatggctctagtgggagtgtagcagtgaggacaaccagaggtcactctcattgctatcttggttttggtgggttttgaccggcttctttactgcaacttgttttatgagcaaggtctttatgacctgtatcttatgcagacctacaatctcatcctgtgacttagaatgacttaaccctctgggaatgcagcccagtaggtcccagccttattttacccagcccctattcaaaatggagttgctctggttcagacgcctctgacaattttaaagctaatgaaaaaaatgtctagccaaatgtatatatacatacatatataattatgaaaagataatgccttataatcttgattcttaaattgaggtatattgatagtattctcccaatggtctggggattaatcaataggtaatttatacaaaactgaagtgctgccaaatagaattataggagtagctgctgcgcaaaaaagattaatgagatttggggagactttgctgtggctaatatgatgggtcaggaagagtacaatctcagtacaattttaagttgtatttatcttatgaataattgggctattctttcatatgcccaagggccattttatagctctatatttcttttgtgttctgtttggggcttgaagtctctacttctgtatcgggattgcaatgcctgctgtcttactgtttccatttgtctggtaaattttcgttcattcctttatttttagctatttcaattgctgcattttcggtgtgtatcttgtgtgcagcacacagttgagtttttgctatacgagccaatccgaaaataatcttttttaataggcaaattaagccgatctagttttgatataactaccatgtttgatgtcaattctgtcatattttagattgtaattgctgaatgtattatatttactgtgtctatcctcttgcgttttcttttggcttatgaattttgtgtcttttatttatttatttatttatttatttatttatttatttagagacggggtctcactctgtcgcccaggctgcagtgcactggtgtgatctcggctcactgcaacctccacctcccggattcaagcgattctcccgagtagctgggactacaggcacgtgccaccacacccaactacttttttatttttagtagagacggggtttcaccatgttggccaggctggtctcaaactcctgacctcaggtgatccacctgcctcagcctcccaaagtgctggaattacaggtgtgagccaccgcgctgggtcttgtatctttattctaatgggttgcttttatactaatcttctgtagtgctcttactcccttttttttttttttttttttttttttaagacggaagtctggctctgtcgcccaggctggagtgcagtggcgcaatctcggctcactgtaagctctgcctcccgggttcacaccattctcgtgcctcagcctcccaagtaactgggactacaggcacccaccaccacgcccagctaatttttttgtatttttagtagagacggggtttcaccatgttagccaggatggtctcgatctcccgacctcatgatccacctgccgtggcctcccaaagtgctgggattacaggcatgagccactgcgcccggccccttttttctttcttaacctgttactatctgtcttttctagatgatactgattcccacctattacctatatgtcagtcaatggtgttactctacttttccccttttctctcccttctcccacctttttagttgtatttgttctactttatcagtatataatgtttacatatccatgtttttcattaacccatgaacgaactcttacattattctcagctctacagtcaaatatgtgaaatgatctctgttggtccttttgttcccagaaatattctggttgggtgaaactcaccctccagtaaattgctcagcaagagcacgtgtactgtattcctggaattctggtgagtttgaaactgattttctgtgaccttgaaacttgaagagcagcttgtttttccttaggtttcttgaaaatggtgttccagtgttttcttggtttgcatgttatttttgagaaatctgaggccaatctttaattctctttgtaaatattttttgggcctggaagccttgaggattttttttttataagtctaataattttccgagctatctcagaattatttgtggtcagttttcctatataccacactgggccctttcagtgtagagttgactcagttcttttatttctggaactttttcttggattagagttttaaatattctgttatattgtttttcttttcttcaggaacaccaataatacaaatatgcaacctcctttgtctggcttccatttcaactatcttctctggtcctttttattttatctccttttcattctcttggctatccttcttttattcaataccctttattaagtttttatttgaacccattctcttcggggcaccttgtaatctgttctttattactgataaagttttgtgattttcttctattttttttcctgaatttaatcagctctggcttcattttctcctattttttgttgatttctctacctagtttttatatttccgattcaacatattgatattttccatgttcccagatgcaggttggagaatatttcataaatattgagtgttgtcttagaattttcatcaagttcatggttatatcgaggagacatcaccagcagaaaaactttgatttgcaacttctgactttggcagttgttctctatagaagttggtccactccttcctcttcctgttcattctgtgggcaggagacctagttaggagcagcttcttccctcagttcaacaatgttctgtgcagttgcttctgtggctgatgttgacaggaaagatagaagagttgttgtgtctcctattttctgcaggatgcttaattttgttctgtctcctcttctgctgtgcctgtctcccagaagcaccactcctctccctgtgtctgattctccccaacaagcatggattctccatgtctggtctgcacactgtcaggccccactccggagcctgggctctgaactgccaagtgcccatcattgctcgttttttttggttttttttttttttttttttttttgagaccgagtttcactcttgttgccgaggctggagtgcaatggtgcaatcttggctcactgaaacctctacctcctgggttcaagcaattctcctgcctcagcctcctgagtagctgggattacagacgcacgccaccatacccggctaatgtttgtagctttagtagagacgaggtttcaccatgttggccaggaggtctcgaactcctgacctcagatgatccacccacctcggcctcccaaagtgctgggattacaggcgtgagccaccatgcccggccttgttcattctctttgtaaatattgtttcactttatcttttgggagtggctttgtctgttttttctctaagttctctgcttccctccacccttttccccaatctcttgagactcctctcccctgatttctgcacccataggtttgtggtggctgcttgctgcaggcccacagtgggcactctgttggatttttttttcttctatgcacagataattggaaaattgcagcttctcttatctcttagtcatgctgaaagagggacatttaccaccattatgaggaaatctgcacactggtatatttttaaagtgccccagatgattctaatacacagctgtggtggagaacatcttgttatatcatcataatgtgcttttagtacattttacatatattttcccaaaagtcccttggcttcccagccatgactgtctcatttttctcctacctgagtcctgtaggtaagagaagcactgtccttcacatctctgtttctcaaagaattcacctacatcagaatcacctatgagcctggccaaacattgcagttttccagatcccattctgggcctactgagatcatctctggagacccaggactctgcattttcaacaagcacacacacacacccatgattaagctgtgaaggatcataaaaatcactgctttggatgctggtggaccctgagtttctgctcttgcttctcttctctacactgtctaacatcagccacatgaaaagtatttattataattcatatatgcaaagcaataacttaaacctaaatcttttcctgagttaagagacccagattcctgtctttgctttaaaatatgcactatgattataaatgcaatgcatgttttagaaaatacaggatgtaggcaaggtacagtggctcacacctgtaatcccagcactgtgagaggccgaggcgggtgaatctcttgaggtcaagagttcgagaccaacctgggcaaaatggtgaaaccctgtctctactaaaaatacaaaaatttagccggacgtggtggtacgcacctgtgattcctagctactcggtaggctgaggcaggagaatcacttgaacccgggaggtcgaggctgcagtgagacgaaattgtgccactgcactccagcctaggtgacagagccagacctgtctcaaaaaaaaaaaaaaaaagaagagactaattttggcctaaccatacacaccattttctgatttaggctagtcaatcaggaatgactgtcttgtagaggatccttgaatggccctgtgtctattaatacgcttctgttccctgtcccctacatacaaacatgttaaggctctacactggtatgactttgggcatatacgaaaaattggagtggaaattatttatataattttcttgctttcatcatgcagtcactttgttgaatacatttgcagatcaaatcagaatatgaagatcctttatggctattaaaccgagaaaatctatcctctgctaactaaccagctctgaggcaactagcagaggcagcatctcatttctaacattgctctatttcaaaatgttttagaataatttccaaagtaaatgacttttattgtccataagatttcttggacaacctgttttacacattcagagcatacaatttttaactaccctggccgggtgcggtggctcatgcctgtaaccccagcactttaggaggccaaggcgagtggatcacttgaggttagttcaagatcagcctggccaacatggggaaaccctgtgtctactaaaaacacaaaaaatactcgggcttggtggcatgtgcctgtaagtccagctactctggagcctgaggcatgagaatcgcttgaatccaggaggcggaggttgcagtgaaccgagatcatgccactgcactccagcctgggcaacagagcaagactctgtcttaaaaaaaaaaaaaaaaaaaaattaccctgaactacgttcttcctgagctgaactctattcctccaaactaggagactttctcagtgttttcaaccttccctccttccatttgtaagatggtcacagatgtttcatcttggttcattcatttaaaacagctattgcgtgcctactgcatatactcagacaatgccaggcactagcaatacaatggctaaaaaaaaattttttagaagatgatcctggccgggcgcggtggctcacgcctgcaatctcagcactttgggaggccgaggcgggcagatcacgaggtcagaagatcgagaccatcctggctaacacggtgaaaccccgtctctactaaaaataatttaaaaaatagcctggcgtggtggcgggcgcctgtagtcccagctactcgggaagctgagacaggaaaatggcgtgaacccgggaggcggagcttgcagtgagccgagatcgcgccactgtactccagcctaggcgacagagcaagactccctctcaaaaacaaaaaaaagatggtcctaatttcaacaccttgtatgttaggtctctggataagcattaccacctttaacagcggtttatacagtacaaattgtattttgccacagatctgcaatttgagtagggctcagtgaggaacgctcctgtctccacacagcactcacagaggcagctgaactgaaggatgaggaatgtgtttccaagatggcgccctcatgtggctggtgagttggtgttggctgtcagcttgggagttcggctggggtcctcagttcctctccacaagcaatgtgcacctccatgtggccctggctttctcagagcatggtggctgggtttcaaggatgaacatcccaaagagagaggcagaaactgtattgccttttatgcctcaccctcaaaagttccataacattacttctgtcatacccagttggttccaaggcaaccacaaatgcctgcctaggtcaaggaaaggggacatagattccatctcttgatgggaagaatgtcaaagaacttgttttaaaactaccacatttggataaatatacacattctattagggataagtatgggtaatggccatttcctgtcttggtcagctcagcataattaactagtaatgaaagacaaggatgttaattcccttggtagggcaatttctttttataatttccattctgaactccaggttcccagttgcctgctgaatatttagcagacatctcacgcttaatgtgtccaacatctgactccagatgtcttgctcctcctttagcctttcacttctcagtaaatgataactccattcctccattcctgcacatacaggtgcacactgcacatggagaggaactgaggcccccagccaaactcccaagctgacagccaacaccaactcaccagccacatgagggcgccatcttggaaacatacccccatccttcggctcagctgcctctgttgagtgctgtgtggagacaggagcattcctcactgagccctacccaaattgcagatttgtggcaaaatacaatttttacttataaaccactgttaaaggtggtaatgcttatccagagacttaacatacaaggtgttgaaattaggaccatcttttttttttttttttttttttttttttgagaaggagtctcgctctgtcgcccaggctggagtgcagtggcgcgatctcggctcactgcaagctccgcctcccgggttcacgccattttcctgcctcagcctcccgagtagctgggactacaggcacctgccaccaccacgcctctgtggatgccgtgtggagcagacaggagcattcaccactgagccctacccaaaaatcgcaacgcactggttatctgttcaccttattcccttgtcttcttaggtctttgatcaaatgtcaccattttgatgatgcttttcctgaccatggttgccaaaacttaactctctcccctgccctaacagcatacgaagaagcatttcatatatccttctcttcatcacttttctcctgggcaccatctgactcatatgttttactcttttatttgcttattgccttcctctcacaagaacgtaaacttcgcaaagacaagatttttttttgtctgtcttcttcacggatgaatccttagtgtttagtctagtgccttgtgcatgatgatgctcaaggagtagttgttgaataaatgagtgaattgaaattggcacactttggcaagtagcacagagaaaggatcaaaaaggtaggaaaatgggaggaaggagaaggacttactaaaatattagacactagaaagtgaaactgcttttgcaaaaattataactgaggaaactatgacagtgaaagagatcaaacctaactgactccatcttgcttctaaccttcaagctgttcttgttcattccttggcataggctgaactaaccttgggaataaatttagtttatagtttaactctgaaacaaaattgataataaccctttcccaagactaacatattaactacaagattagaaactacagtttaggggccatgcgacctccagctccaagagtctgaacctccccaaattgctcctgggactaacatcactactgtaaaacctaagatcagtgc

SEQ ID NO: 196 - DNA, 3593 bp, Homo sapiens
cgggctccgtcagtttcctcggcagcggtaggcgagagcacgcggaggagcgtgcgcgggggccccgggagacggcggcggtggcggcgcgggcagagcaaggacgcggcggatcccactcgcacagcagcgcactcggtgccccgcgcagggtcgcgatgctgcccggtttggcactgctcctgctggccgcctggacggctcgggcgctggaggtacccactgatggtaatgctggcctgctggctgaaccccagattgccatgttctgtggcagactgaacatgcacatgaatgtccagaatgggaagtgggattcagatccatcagggaccaaaacctgcattgataccaaggaaggcatcctgcagtattgccaagaagtctaccctgaactgcagatcaccaatgtggtagaagccaaccaaccagtgaccatccagaactggtgcaagcggggccgcaagcagtgcaagacccatccccactttgtgattccctaccgctgcttagttggtgagtttgtaagtgatgcccttctcgttcctgacaagtgcaaattcttacaccaggagaggatggatgtttgcgaaactcatcttcactggcacaccgtcgccaaagagacatgcagtgagaagagtaccaacttgcatgactacggcatgttgctgccctgcggaattgacaagttccgaggggtagagtttgtgtgttgcccactggctgaagaaagtgacaatgtggattctgctgatgcggaggaggatgactcggatgtctggtggggcggagcagacacagactatgcagatgggagtgaagacaaagtagtagaagtagcagaggaggaagaagtggctgaggtggaagaagaagaagccgatgatgacgaggacgatgaggatggtgatgaggtagaggaagaggctgaggaaccctacgaagaagccacagagagaaccaccagcattgccaccaccaccaccaccaccacagagtctgtggaagaggtggttcgaggagaggtgtgctctgaacaagccgagacggggccgtgccgagcaatgatctcccgctggtactttgatgtgactgaagggaagtgtgccccattcttttacggcggatgtggcggcaaccggaacaactttgacacagaagagtactgcatggccgtgtgtggcagcgccatgtcccaaagtttactcaagactacccaggaacctcttgcccgagatcctgttaaacttcctacaacagcagccagtacccctgatgccgttgacaagtatctcgagacacctggggatgagaatgaacatgcccatttccagaaagccaaagagaggcttgaggccaagcaccgagagagaatgtcccaggtcatgagagaatgggaagaggcagaacgtcaagcaaagaacttgcctaaagctgataagaaggcagttatccagcatttccaggagaaagtggaatctttggaacaggaagcagccaacgagagacagcagctggtggagacacacatggccagagtggaagccatgctcaatgaccgccgccgcctggccctggagaactacatcaccgctctgcaggctgttcctcctcggcctcgtcacgtgttcaatatgctaaagaagtatgtccgcgcagaacagaaggacagacagcacaccctaaagcatttcgagcatgtgcgcatggtggatcccaagaaagccgctcagatccggtcccaggttatgacacacctccgtgtgatttatgagcgcatgaatcagtctctctccctgctctacaacgtgcctgcagtggccgaggagattcaggatgaagttgatgagctgcttcagaaagagcaaaactattcagatgacgtcttggccaacatgattagtgaaccaaggatcagttacggaaacgatgctctcatgccatctttgaccgaaacgaaaaccaccgtggagctccttcccgtgaatggagagttcagcctggacgatctccagccgtggcattcttttggggctgactctgtgccagccaacacagaaaacgaagttgagcctgttgatgcccgccctgctgccgaccgaggactgaccactcgaccaggttctgggttgacaaatatcaagacggaggagatctctgaagtgaagatggatgcagaattccgacatgactcaggatatgaagttcatcatcaaaaattggtgttctttgcagaagatgtgggttcaaacaaaggtgcaatcattggactcatggtgggcggtgttgtcatagcgacagtgatcgtcatcaccttggtgatgctgaagaagaaacagtacacatccattcatcatggtgtggtggaggttgacgccgctgtcaccccagaggagcgccacctgtccaagatgcagcagaacggctacgaaaatccaacctacaagttctttgagcagatgcagaactagacccccgccacagcagcctctgaagttggacagcaaaaccattgcttcactacccatcggtgtccatttatagaataatgtgggaagaaacaaacccgttttatgatttactcattatcgccttttgacagctgtgctgtaacacaagtagatgcctgaacttgaattaatccacacatcagtaatgtattctatctctctttacattttggtctctatactacattattaatgggttttgtgtactgtaaagaatttagctgtatcaaactagtgcatgaatagattctctcctgattatttatcacatagccccttagccagttgtatattattcttgtggtttgtgacccaattaagtcctactttacatatgctttaagaatcgatgggggatgcttcatgtgaacgtgggagttcagctgcttctcttgcctaagtattcctttcctgatcactatgcattttaaagttaaacatttttaagtatttcagatgctttagagagattttttttccatgactgcattttactgtacagattgctgcttctgctatatttgtgatataggaattaagaggatacacacgtttgtttcttcgtgcctgttttatgtgcacacattaggcattgagacttcaagcttttctttttttgtccacgtatctttgggtctttgataaagaaaagaatccctgttcattgtaagcacttttacggggcgggtggggaggggtgctctgctggtcttcaattaccaagaattctccaaaacaattttctgcaggatgattgtacagaatcattgcttatgacatgatcgctttctacactgtattacataaataaattaaataaaataaccccgggcaagacttttctttgaaggatgactacagacattaaataatcgaagtaattttgggtggggagaagaggcagattcaattttctttaaccagtctgaagtttcatttatgatacaaaagaagatgaaaatggaagtggcaatataaggggatgaggaaggcatgcctggacaaacccttcttttaagatgtgtcttcaatttgtataaaatggtgttttcatgtaaataaatacattcttggaggagc

SEQ ID NO: 197 - protein, 769 aa, Homo sapiens
MLPGLALLLLAAWTARALEVPTDGNAGLLAEPQIAMFCGRLNMHMNVQNGKWDSDPSGTKTCIDTKEGILQYCQEVYPELQITNVVEANQPVTIQNWCKRGRKQCKTHPHFVIPYRCLVGEFVSDALLVPDKCKFLHQERMDVCETHLHWHTVAKETCSEKSTNLHDYGMLLPCGIDKFRGVEFVCCPLAEESDNVDSADAEEDDSDVWWGGADTDYADGSEDKVVEVAEEEEVAEVEEEEADDDEDDEDGDEVEEEAEEPYEEATERTTSIATTTTTTTESVEEVVRGEVCSEQAETGPCRAMISRWYFDVTEGKCAPFFYGGCGGNRNNFDTEEYCMAVCGSAMSQSLLKTTQEPLARDPVKLPTTAASTPDAVDKYLETPGDENEHAHFQKAKERLEAKHRERMSQVMREWEEAERQAKNLPKADKKAVIQHFQEKVESLEQEAANERQQLVETHMARVEAMLNDRRRLALENYITALQAVPPRPRHVFNMLKKYVRAEQKDRQHTLKHFEHVRMVDPKKAAQIRSQVMTHLRVIYERMNQSLSLLYNVPAVAEEIQDEVDELLQKEQNYSDDVLANMISEPRISYGNDALMPSLTETKTTVELLPVNGEFSLDDLQPWHSFGADSVPANTENEVEPVDARPAADRGLTWGSGLTNIKTEEISEVKMDAEFRHDSGYEVHHQKLVFFAEDVGSNKGAIIGLMVGGVVIATVIVITLVMLKKKQYTSIHHGVVEVDAAVTPEERHLSKMQQNGYENPTYKFFEQMQN

SEQ ID NO: 198 - DNA, 21166 bp, Mus musculus
  misc_feature (1)...(21166): n = A,T,C or G
ttggctcacctcccacctttacttgagttatgtcattttccatataaataaggaaacctctctctgtctttcccccttctctttctgccaccaactccccacccccaccccactgccctgcaataaacctctcacacgtggaactgtttgggcccagtgagctgtgttcagactctattttaacacatcagccttgacctccaatttgtttgaggttttttccctaaatatttatttatttatttaatgtattaatgtacactgtcactgtcttcagacacaccaggagagggcatccgatcccattacagatggttgtgggctaccatgtggttgctgggaattgaacccaggacctctggaagagcagtcagtgctcttaaccactgagccatctctccagcccccttttagagttttttttaacagcaaacctgcaattgtgactgtcttagtcagggtttctattcctgcacaaacatgaccaagaaacaagttggggaggaaagggtttatttggcttacacttccatactgctgttcatcaccaaggaagtcaggactggaacttaagcaggtcaggaagcaggagctgatgcagaggccatggagggatgttccttactggcttgcttcccctggcttgctcagcttgctttcttatagaacacaagactaccagcccagagatggtaccacccacaaggggccctccccccttgatcactaattgagaaaatgccccacagttggatctcatggaggcacttccccagctaaagctcctttctcagtgatagctccagctgtgtcaagttgacacaaaactagccagtatagtgacatatacagaaaggcatctgcaggcatctgtagcaagctagtatcgtttacagaagcagaaagatagcaggtaactggccaggtagttcttataactgttaggtcagggacacgttgaataggaaccaacttctgtatttgtcagggttctctagagtcacagaacttatggatagtctctagatagtaaaggaatttattgatgacttacagtcggcagcccaattcccaacaattgttcagtcgcagctgtgaatggaagtccaaggatctagcagttactcagtctcacacagcaagcaggcgaaggagcaagagcaagtgaccagagaccagtctacccaggacagttgtagcactcacagcgttcataggactacttccagagatggcataactatatgcagtgggccactacactgggccttgggggtgggggtggtactcacggtgaagaacccatcctcatggaattatcactgggaagctggccagcttggcacttctggtctctagaattacaagcctaaatgaacctcagttctttatacgtagtctcagggactgtggtgtagcaatggaaactcggcagaggcagactggggttctagatggtagacccagggcttcatccacgtcatcagctttaagaaaccctagctgccagcagagtcaaccaacctggacccttggggactcccagatattcaaccaccaaccaaagagtgagcaccggatgaacctaggccccccccccccacacacacacataagatgaacagcttgatcttcatgtgagtaccctaacaacaggggcgggggatgtccctgaatctgtcacctgcctgactacccatggatcctgttcccctaactgggtcaccttgtctggcttcagtgagagagggcacacctagtcctgcagcaatctgatgtgctggtggtaatagggagtaccaaggaagggcaaaacctatatggaggctcccccttctcaaagaagaaggggagggaggaatggggcaggggttactgggaggagaaggggggctgatattgggatgtaaagtgaatacataaatacatttaataatttttgtttgtttgtttgtttttcgagacagggtttctctgtgtagccctgactgtcctggaactcactctgtagaccaggctggcctcgaactcagagatctgcctgcctctgcctcccaagtgctgggattaaaagcgtgcaccaccactgcccggtgggcagagagtctttaaagaggaattttctggatcaggttggcctgtaggcctatctatgagggagtgtctagtttgctcatagatacaggaagatctagtctgttccctaggcaaaggtgttctgaaaagtagaagaaaggggagatctaactgagggcaagcaggtaagcaatcaagccatgaccccacgcacttctctgctcttgactgcagatgtgctatgactaactgagttcctgccttaacgggaatgatatgtggtaacttggagttataagcaaataaactcctttctctctaaattgtttattgtcgggctatttgtcatagcagcagaactggaaccagaacaccaagtcttcgaaagtcagtccatgctttatactccatgcgcccgatgggtacaacttaccacatgccaacacccttggtcacacaattaccttaaggaagatccagcacagcagtttttttttttttttttttagatttattttatttctatgactacactgtagctgtcttcagacacaccagaagagggcaaaggatcccattacaaatggttgtgagccaccatgtggttgctgggaattgaactcaggacctctggaagagcagtcagtgctcttaatcactgagtcatctctccagccccaagcacagcagcttgaaggaacccaaaagtccaggctgctaggacaagacattctatccttggtggcctggccatgctgagatctactggtcctggggcttctgagaacacagtaagagcaggtagcctagcatctgtggtgtgaggagagggccggggcctgggggtggggactgttccaggaacataatttctgtcattcagaggaaactgaagagcacattcataacttgctttatctctttccgatcctgttttgccatctttccggcagggtgtactgaggcaagaaaaagagattgcagtgtcagaaaggtctcggccaaccaggtgttgcgaatttcgtggcctcactgggtgtggtccagacatatccatcttcccccaaactccaagtcttttagtaaaaggataaaggttgagaagggaaagtggaatcacatgaataagttagttagcactgcaaaggcgctgccaagtgtctgaaataaatagtgcagtctcccagcctgtgagcagagccctggcctgaaaggcaccgtactgaccatccattggtcctggctcaacagggatggcagtgatttgtagctttctctggccctggtctgaagcaagtcagccagtaagtggacatgggtttctgcagagaaggctcctatcttgaggactgaccttcggcaccctggagatgggatggtagaaggcttcaggttcctgactggggaaatagctgctgtagctattggcctgggctggggaggtagaggactaagtcctgaactgggatctggtataggagggtctcccgatttttgcccttcttgaaccctatcctagtgtgattaccattcagtaatctgttttcacttcccacttcccagacagttcattggtttacaaacaggaacagaaattttggagaaagtagaactttgaagaggccactgaggaggtggtggaggcgggggcggaggtggggtggggagggtgtgtggggtatgaagcaatcttatgtaacccctcccccatgcatgtggatcttacaccacaatggttctataaaagtgcctgtgactccaccacccatatgaacttccttgaaacaagagcttccttgcttcctttaagcacaaaaacatggttaagagggatcctgactcagctccagtgccatccactgtggtttgcatcaacagtgatgttatccagccggatcacattacctggtctacatttaacacagtgttcatgaatggctgctgcctgggtttcattgcctacatctactcggtgaaggtgagtgttgtagaaggtatgtatgtggttgtggctcctcctgcccagaggacacctgggtcatgtacagctttgtgtttgtgtatgtgtgacacaccttggtgtcctgaatgtacttatgtgtttgtatgtatagactgtgtaagtagcatatagaatgtatatgtgggttgtatgtaggagactctcctatgtaagcaaaaggagagaatgcccagggattctggggtgagactgtctccactctagtttagagggattcattctgcttactgcttagtttctggaatgccccttcaccctgcagactggggcaccaggctgggtgcaagtgagacttacaaaaaatggtgccccatggtgagctgagcatacagttcttgggtctgctgaatggtctgagtgtgtgaaagggagaggggtccctgatattaggaaggagactgcactgagcgggaaggacaatggggaaactgaggcaaagcatctggctcttgatgacttgctccaaggccacactgatcttttcatctctttcagtccagggaccggaagatggtgggcgacatgactggggcccaatcccatgcttcaaccgccaagattctgaacatccttgctctggtcatctccctcatcttctacatcatgcttatcgttttatacagctttaacttactaggtaaccaaagataatagaaccactagttaggtactaactagttagttagctaattattaattaactaaactagtaccgaatttagtatctttagtacctattagatactaagggtgggactccatgcactgtcaaagtcaatggactactaaattcttccatgcactgtcttcgtgaagaaagcattcatgtgctctgcccctcagagttgccccttatcctggccagaggccctaacctgtcactctaccctcctgtaaatgtttatcctcatgcatatgttcacagtggattcaataaagtgcacgtggtagcgattgtggtgagacttcctatcccctgactgctccctactgagcttactcagagtttccctggctttctccttgttgaagaggtaggggtgtggatggggtgggtgtggatgggtgtatagtgcagggcatccacagataagtaggattctggcctcaggatggagacagcagctgacaagcatcctgaatagtgttctcttttacctagcagtcccaggcaggcagtaactaagcattgcttacctccggctccatgtccctagagtacaggaagggtgcagaggcatgtactagtgagttttcagtccagggatagaggaccagcccagggtcctccacttttaggaggaagaaatcttgacccagacacgctgtgttcaagaactctatggtggccttcggcttggattctggcccctcccttctcacacacatctcacaggcttatttcaggtcagggatgggcagtgggaagtgaccatggaatctttgatgctaggtgccatgttgatccagggtattatctctctgtgagtcctcagatcctgaagtggggagggtcaggtctggaggggccttggcacccttcattagtctgtcctcaaaattcacctgtgggcatacattttttgcaacctacttttattaagggttcaacctctcctctagcctaccacctagcagaggtagtggaagagaagttattaggatatgggggaaacgaacttcttcagcaatagttctttgggggtgagcttgaatcttctttggcagcagttcagtcctgtaagcaaacactaaatacgacttagcagctgcagagcagtcctccaggcaggcagacaccacacatgaaccagcagctacagttcagtcttttcagcaagcgacaccaggcacaaaccagcaacagtaactaaatcctgaagaaacctccaagcttgccaacaggcctgaagcaagactgcagaagcagcaggctgccgtaggcacctcgagagcagttcttgggcaagtttctctcaatggtgctattatcacaagttgaactcagtgaccctatgtaaggagaaccaatacatgtgtgttgttaatgaagaataacgaggcagagcaaaccaaaccaatgctcagcgctcttctcccactgtccgtggattcatagctacactccttcattaagcactctttcatgtgtttgctatatccaaacatcctttcacctgtgtctgcttcaggaaaacagtctttcatgtgtttgctttagcaagtcatcatttcacctgtgtgccccagcaaaacagcacttgctatcactaactttccaaagagctagaagtttccactttattttcctctcctcttcctggatgccctggaatctgtatttctacctcattttgggcaccccaagattacaagtctttggagccctcaggtggcactgtctccctgtgttggtatgtaggttctagtcctggggtctgagataatgagaggcccccaaaactcatcttgtgaggctgagcagtgttcgagatgccctcttcactgaggtccaggcttctgaagcagtagcaattcctttactgtcttgggaagctgagcccatcttaggaagacagaggccctaataccagtggagacaggatcccactgggagagctgctatctttctggaggggagtgagtggttcagccagaccaagtcctagggagaaatcaagactttttcagattgcaccaagaaggaacaagaggttttttagaaggacccagggtggaatttccactaaaactcatggccctggactgaacttcagagtgttcatccttagtcccaggtctgtgactgaatgaaggtagagatttcaggaggagggtcactgtggccacacttcggtccgttctagtgctttgtatgagcagtgtgtgggcagctatcctgagagtgcagaaacctcgcgtgtgttaggcactggtgcacacagaagccagggcatgatctccagaatgaaccccatcctaaccatttgtttgcagtggaacatatgagactagatctgtctggggtttacaacaacccatgagtgagcccaccgtggagagtcctggtgctcgcttcccactcaccaaatgtgtaattggagcaggaacaatggaagtcattataacttcccattgtgttggtggcctgcagggcaaggttgagtggttcgctgggtggcagaagactccaggttgttccctatctaatgctagagagtaaacaaaacaatgtctcctcctgagaagagagcagagaaaccctgtgctcaggctacaccaagacaatggactcctgcaaatccaccattaggaattcatttggagatcagttgcaggtagcagatgctaagtaggtctgaaaggtaagggatactaaatcagagaacatgggcactggccggaactgtcccctgagaccagagtgaggacagaacctgacaggtaaagtgtcaacagttgtgcatcaggggcagaagtgggtcatcctgggtggagcaaaggctgaccctgacccttgttcttacagcagggctggtcaatccctgtccctctgatgatccctgggggcagagattgcccttagcacttaacaaagaagatggaaaaatccaaagactgagtctcaacttcccctgatgtttcatatgggaaggagcgagtcagacaggaagaggtcttctgtccagctcacttgggggccacaggaagacactgactagggtggtcatacatgcagggctgagtatagctccccacctctgtgggtggggagacgagcctggggattgagtgcatgtgaaggccttgatatgcaaagccctcaggctcatcaaggccaccagggaaataggatccctgtgactgagaaaggcagagaagtggccataaagtttgaggtgaccactaactttcaggatggtctgagaacatccaggagcaaatgtgttggccttcaggaacgttgggagaccatagtaaacagagctatgactgaagttaaatattgttcactatttaaaaagttatataccaagccgagcgtggtggcgcatgcctttaatcccagcacttgggaggcagaggcaggcagatttctgagttcgaggccagcctggtcaacagagtgagttccagggcagccaggaatacacagagaaaccctgtctcgaaaaatcaaaaacaacaacaacaacaacaaaaaagttataccaagatccatcattcctgaaaccagagtgtgttgtgaccacaggataacgcttgctatcacttaagggctgggtgtgtgtgtgtgtgtgtgtgtgtcattcatattattttatctcccactccgctgagaggcaacagaaggatgtgtgaagagcagtgtgaagtaggccttggagaggtatccgcagaacagaaagaaataacaccagaaaccaacagaaaccaccactttcaggctccaatcagagtccctgtggccagtccaaagccctacccctgaggcctgaggcctgactgaggcctggaaggaggcctctgtgaggtaggtacgcccatggaaaccactctacctagcttcccagaggcagactttttcagagatgttgactaaaccagcaccagctaataggactgcaaagaagggagtctgtaggaggtgctgatgtctctgtgaagaactcaagaaagataatgaaatgagtggaacctagaaactagagcagccccagctcccaagactcagggcactaggaagggtgggtgctgcagggcaccttgaaggagatctctgtagtagcctggtccttccagtgccaccaagatagaaagtggatgcaagtcctaacaagagaagccaggccagatgtccctgttatcactgagtccttcagtatgatcaggagtagctttcctggtcacagccctcaccccaccaagcgtttgagaaagcgtctctggtaggacgaaggtcctctcggtgaccatgccactagcactaataaattttgttagggcaggagggaaaaagagtggctgtagcaccaacaggccagcccaggaccatgaggtcagagccaagtgaccgaagatcatttagttctaataccaaagtccagtggttgatcacacttagggcactagggctctgcaaggagagagacacagaggcgtgttagcattttgtctaggctctgccccacagttatctggcaacagctgggtgtgcctgactcacactaaaaggggctgctcccccccttactctctaaccttcctgcacctgcttccccctcctcattccccactccctccgagtgctcatggccagcctctacttctctgttctctctctctctctctgcctttctctgtctctactaccctctcaaccccctccccatgaatagagaataaactctgttctatgcgataccaccgtgtggctggtccctcaaagggaagggacgcttcagcgtgggcctgcagaggccccccctcccccaacatatgactgcatagccaccgaagatattccttctctctcctctttaaaacacaagaagtaccgttcatcccacctgtctatgaagccaggagaactggcgttcatagtgagaggctctctgggcactctttattgctgaataaagaatagagggttctttggggcctggctgggaccttgataaggaacagtgaggttctgcagctgtgagcgtgagcttggttgactccaggacccctcactcttaaacactgaggtttgggccttgggacaagtcctgacttgggctcctggcctggaagttcccctgattcacaatccttcctgacatcctgccctggagtaatttgatccgcaggctttttagatccccgcccctctgaacccagagcagtttcatcaagccaaaattcaggaaaaggaaacttctgagaaaccgaaactgccgcagaaagggcagacccgcagcgcgctccatcctttgcccttcagtgctgcctttgctccgcaccatgaaccacacttctcaagccttcatcaccgctgccagtggaggacagcccccaaactacgaaagaatcaaggaagaatatgaggtggctgagatgggggcaccgcacggatcggcttctgtcagaactactgtgatcaacatgcccagagaggtgtcggtgcctgaccatgtggtctggtccctgttcaatacactcttcatgaacttctgctgcctgggcttcatagcctatgcctactccgtgaaggtgagtgtgctagaatggggggagtgatggtgtaaaaaggtgtgtgtgaacctgaagctccatctacccagatggcaccgaggtatgagtgtggggtcctttgtttaaaataagtttgtgttcattcttctgtggtgtgtgtgtgtgtgtgtgtgtgtgtgtgtgtgtacacgtgtaggcttaaaggctctctgggggcagacacagggtgaggctgcctggggattctggagtcagactcttccaatgcagagatgcctatagcaccttcactcaacagactgggattctagcctgtgtggaaaatgttcaggagattcatggggaacaatagcctacagtggggtgaacaacaagtgctagggcctcctggatgatcagaggatgtaaaatgttcctgacctaagatggggagatgcagtccacagggagtacgtcaggaaaactgtcagagcatctgcctatcagctccagggccactgaccgtgtctatctgttctgctccagtctagggatcggaagatggtgggtgatgtgactggagcccaggcctacgcctccactgctaagtgcctgaacatcagcaccttggtcctcagcatcctgatggttgttatcaccattgttagtgtcatcatcattgttcttaacgctcaaaaccttcacacttaatagaggattccgacttccggtcctgaagtgcttcaccctccgcagctgcgtccctccttgcccctccctacacgcaggtgtaacactcatttatctatccacagtggattcaataaagtgcacttgataaccaccatcctatgactgcttttattcctcccacccctctatcttccttgctctgaggtggacatgtaggttatcctcaatttggcagtagtctctggcctgctgttgtggacatttgctggccaaagtcctggatggtatttggctgcttcaggcagggagaactcaagcttcaactggccctggccccacatttccagggcacccagtccagttcagaagtggaggaccaggtctgggtccgtattcttctggacgaatactctgaaccagacaagatggtgtcaaaagttccatgcctgcttcccgggggaaccctgggctgatcctgtccaggatttgctgggtgctgtggtgggggcctggtgtcccctactggtcccacagcagcgatgcagttcattccttgtcgccctggagcctagaatgaccttttaaggctcaaagtcgctgccctggcgccccctgccggcactctgcaggtacggtggccgcgtggtgcttccattcccccacccccccaccgaccccgctcccccggaccctatatggtaagggagagcgccaatcacgccttcttgtgccggggtatgcaggactcacctctctggtcgggatcctagtacccacgtttccacttcacttagtgcattgagtttaggagtctcctgggaatggatgggcgctatctgtttctgttggtgcaggggtcaatcattcatctcatagctgcctttccaagggaacttatttctggttcccagaggcaagcacctcaaaagtagcctggatctatgggactccgtttgtcctcctaaatcattgtggtggggttttaatgtcaccatcatacccagggcagcacggtggatctgaagtgccttggttagtggaaagtcgctgtagtggttgcagccaggaatttgggagtgggtgtggtgggtagaaaggggtgggggcacttttgcaagttaaagggtttgggtttcttatccagggtggcagagccccaacttgttccccagtccggattctgacagctgacctgcccagcggggaatttaaccaccagagggaaacaaaaggcagcttcaagggatgtgcctagcgctcttctcaccggcacaggatgtcaggctccctgggagggtgtgtggaaagaaggattgagcaatggggtttacaaactagctctgaggtatggaacaagattcccctgctggtggggagccttcctctccgccaagcagctatggtttcccagaacacacttttttttttttttggtttttcgagacagggtttctctgtatacagaacacacttttttaccttcttttcttttctttctttttttcttttcttggtttttcgagacagggtttctctgtatagccctggctatcctggaactcactttgtagaccaggctggcctcgaactcagaaatccgcctgcccctgcctcccgagtgagaacacacttttataaaggaatcttgtcttattggggattggctgagtactaagaggatacaaatgaagcaggatagagatgggaaattaggaggacatgggaaggaagaagccccgtcctggcatctagattgtcttcttcactgactgagagtcaagaaacttgataaagccaaaattccctccatgtctgtcttaatacattctggtattgttgttgctgttgtttgtttcgttgtgtagccctgcctgtcctggaacgtagaccaggctgacctcgaattctgagacctgcctgcctctgcttcctgagagttgaaattaaaggcatgtgccaccacggcctggctcctatcttaatacttaacaaacctactaactgtttggcgctgtcttgtcctgacatttttctggttatcaagggtcaaaccttacctcctttatagaagagcttaagggggaaggagcctctctgggcaccaagggcagtgctaggcatcggctggctcccttactgctgcagctctgatggaagggaatccgagggccacattacccagggcgaggatagcaggaatttctggggaggcaaattttctgtccaagcctctagttaagaattgacctaccccacaaacctgcttagggaacgggtactggagctttttgtggacttggaagtcttttcgactgaggtaaaactgtcatagcacctgatgattcttgtcctcagaaagcggtagccaggccccgcacagcctccttcatgcctagagaacctctgtcttagttgggggttctattgctgtggtaaaacactatgaccaagagcaacttttatttggaggagacggtttactggcttgctccccatgccttgctcagcctgccttcttatcctacccaggaacactttctcaggggtggcaccattcccagggagttgggcccttgccatcagtcgttgtcttagggttactgttacggtgacgaaacagggtttgtttggctcacattcccacatgtctcagggttttaatgctgtgaagagacaccattaccatggcaactcttatcaagaaaaacttttttttcttcctttcttttttctttttttttttttttttttttttttttttttggtttttcgagacagggtttctctgtatagccctggatgtcctggaactcactctgcacaccaggctggcctcgaactcagaaattcgcctgcctctgcctcccaagtactgagattaaagacaaagacaaacttttcattgaggctggcctacagttttagaggtttggtccatcattgtcatggcagaatgaatgcatggcagtgtgcaggcagacgcagtgctggagagttctccatccagataggcaggcaggcagcaggaagggaactgaggtgagcttctgagacctcaaagctgtctcttagtgacacacctcttctgagaaagccacacctgttcgaacgcaaccacacttcctaatagtgccactccctagggccaaggattcaaacccgcaagtctgtggggggccatttctactcaaacctcacaacactgctcttcttcgtttgaggaagtcgggactggaactcaaacagggtaggcacttggaggcaggagctgatgtagaagccatggaaggatgctgctcatcagcttgctcagcttttttccttatagaacccaggaccaccagtcccgtggtgaacctgcccctcccccatcaattactaattttaaaaatgctttacatctgggtcttagggaagcattttctcaattgaggttccctcctttcagaacttgtgtcaagttgacataaaactatccaaaactagtcatcaattaagaaaatgaaccacaggattgcccacaggccagtctggtagatatattattttctcaaacgagtctccctcttccaatgaccctaatttgtatcaaagttacatgaaactagcctgaagcccacgctcatgatagggccatcctttgctgacattcgtgccctttcctgggctgacttgctgcaggtcagtctggttgtcaacctgtatgtatgtctgtgtaccacatgtgtgcaatgtccatggagaccagaagaggatgttggaccctctatagctggagttagttacacataattgttagctgttccatgtgtgctgggaatcaaacacaggtcctctggaagagcagctggtgctattaactgctgagctatctctctagccccacattttcttgattgcgggggggggggggggggcaggagggcagccagggcaggtattcctggcttatttaagaagcaggctgagtgagtcacggaagtaaacctgtaagcagcattcctctgtgctctctgcttttgttcctatcctgagttcctgcctcagtttcccctgatgacagactataacctataagccaaagaaacctttttcttcctgtggtgatttgagtgagaatggcccccttaggttcatatatttgaaaaattcattcctagttggtagaatggtttgggaaggactgggtggtatggccttggtggaagaggtttgtcactggagggtggggtaagctttgatgattcaaagtctctctttctctgtgtgtctctctttctctgtctccccctctctgtctctgtctgtctgtctgtctctctctctgtatatatatatatatatgtatatatatatatatatatatatatatctgcacctgtgagcccccaactcctgctccaatggcatgcctgcttgactgctgccatgttcctgctatgacagtagtcatggtctctggccctctggaactgtgacccctaaagtaaaaacactctcttttataagttgtgctggagtccagttccagccaagttcaggtcccagagaagaggtttgcagtttgcaagggaggggaccaacatgatctgagggtaaataaagatagctgtgtttattgaatacaacttttatactctatatttttataatagcttagccataaacaatattgaaagcagacttaatggctgaaagaaatatataatctttccacaaactttccataatgaaagagttcatcaactttattacagtatttttcttagacacaaaagcagtaagtccagcaagcacctaagcccctattgttctctaagatccagcaactctaccaggtgcccctttgacatttcctcttgcacactctcagtctttgcggtcagcctatgtggtcaggaggtgccaggcatggagtcttgagaaataaacccataagagcaattttcagtcctcagggggcctgaggcagcctttgcaccaggtagcatgataagcatcgagctgtttcctagttgtgttcctttgtgcctcagtcttacaatatgggcatgctctcctcctgagctctgcaaagggaaggtcctgatctcttactctttttccattgtgccacaccatcctgactccttcagtgcctgctcctgcatatggcagaggggatcaagccagtctaacttctcaggatctgcttctcatggggcagaccagacctcgccattcatgctgtaagtcatgtgcccagggaatcaatcatgggcactgccctatacttactaactgtactcctgccctcagctgccaaggcctcgggctctgggtctgggcccattgttttcctctcccattgtgtgctttcatccttgggaccaggtgtatccaggagtttctggcaccatctttcagttagtcaatctttaacttctctcttctgggtgcaaacagaggggcacaatagggattccgagtcatcactctgtgtggctccactgtggcggagacttcttcccaacaatgatttggtttagagagactgccgttgtacacacttacattttctaccacagctcacacaaaataccccaaaggagaaaagcgcaaggaaactcccataatgcatagtgagaatcgtcaaagatgaaagtcgaggatggtggagaactgtggtctgtgatgtccatgtgctggacctttgtcaagcagcggtggcctctgtgtggtccacaccaaagttgccttggccatacatagtgtcttatcccagcaatgaaaaggtaagaaaagcccccaagttgcttttgatcacaatgcttatcagcaagaaaaacaaactaggaactgcctcccctgcccctgccccccagcctataggaacacagggaactctgtgtctttcctggcagaagcagtgagggagctgagtgagtgtcagaaacaaggaaagttccttcatggtgaagaacacagacctcatttgctactttaacctcttcagtaactttacatggagccagtatttccaatttcactgcatggcagaatggatgagagagaggctgagataatatgacttccagacctcctgccctcctcttgatgtactatcttaacaatcagtgtcctgaatgggatcctctgtgcctcctggcatctggctgagcaatgtccccacctccaacccaggggtgacatcgtggagcttggttctgaaatcctgcgtgtagaaagtagggacaaaaggaaaaacccagattgttatgaccctgatttcttggcatctctttgaatctgtcctgtctgagcctgtgaaggatcctcatgcaccttgaccacggcaacttacgaaagaaaggatttgtctggcttatggttcccgagcagtaagagcattccagagtctattatggtgagagagtgtggtagcaggctgcagatgtgttggttggagcacaaactgagagctcacatctcagtccacaacaggaagcagagagagacaactgggaatgcgtgtggcttttgagatctcaaagcttgctcccaatggcatatatcctctaacaaggccacatctcctgtcagtcaccatctggggatcaattattcaaaagtacaagaatatgggggatgtcttattcatactaaggagtttaatttttttgtttttctgtttttgttttttcgagacagggtttttctgtatagccctggctgtcctagaactgactctgtagaccaggctggccttgaactcagaaatctgcctgcctctgcctcctgagtgctgggattaaaggcgtgtgccaccatgcccggctaggagtttaattctttatgaactaaactttaagatgcttgggtctaattgttagtcaagagagaaagagaaaggagagagagaacactggctctttaaaatttaaaacttagtaagttagcagcctgtctcttcagttgacatctcacatatgacccatgaaatggggctgaataaccccttgacagtctaaaatgcttctgtctcctttcagccttggaatgttgtggtggtttgagtgcttggcccagggagtggcattattaggaggtaggtatgaccctgttggaaaaagtgtgtcattgtgggcatgggctttaagaccctagtgctagctgcctggaagccagttttctcctgtctacctttggatgaagatgtagaactcttagttcctccagtcccacatctgcctggatactgccatgctcccaacttgatgataatagactgaacctctgaacctgtaagccaggctcagttaaatgttgtcttttatgagttgccaactgggtgtggtggcgcacgcctttaattccagcactcgggaggcagaggcaggtggatttctgagttcgaggccagcctggtctacagagtgagttccagggcagccagggctacacagagaaaccctgtctcggaaaaaaaagagttgccttggtcatggtgtctattcacagtagtaataccctaaccaagacaaatgtgatatttcctctggaatttggattgggtttatcgagtgttaagagtccttcatagtaggggagggtcactggaactcactggagggtccagccacttagtcttgtgccttcacaccagctgtaattctgtcatagttgccttggagtctcaggaggtgaaagaatatatggtgagtggaagaagttaattggaggggcactccaccaatgcagctagactctgtgtgtgtgtgtgtgtgtgtgtgtgtgtgtgtgtgtgtgtgtgtgtggtggctgcttttaaagtaattccttacctatgctaaatagtcagcaataatctcattggttcaaaattaggtttgggtggaattgtactttgattgttcatggagcccagtaaagaagagatagtgcatgcctttaatcccagcactcaggccgatttctgagatcgaggctagcctggtctacaaagtgagttccagaacagcctatacaggctatatagagaaaccctgtctcaaaaaaaaaaaaaaaaaaaaaaaagggagatagatgtttattcatatctcccaggggaaaagttcttgctacaggtggcctcagtaagagttttcattcacagaccagtaagtagacacatcacactcagtaggtggcagtacttggtactaaggggaaaatttctctttcatcacttccccctaccctcgatgttaccgatgagtcctccaggttaagcccaggcagcccatgagcccctttcacagctttgcggatggggactgaactttagctccttggtctcacagaatcccaagatgtggatcaaggccacgtcacaaaacaggccccttcaggggcacacacttccttgccgtgaggcataggacacggaagccttctgaagcagggaatacagggaaatgtcatttctgtcagcagtgtttgaccccacgctgcgtagaatgcaaactacctcctttgccagcctgggtctgcttctgctctccaggtttccaggcaccattgtgcacggggcgagcaggatctcagctggggtgagtggggaagaaacagccttttccagagacggtttccagggaaaccgctgaccttactgggagtgaacttttcggggtacattactggtcagagctgaggtgctgggtatgcttcatttgcatgaagaggagtcccaggtgcttgctggacatgctcttatagggagagaggaagtttaacctgtcatttggccacctggcgatgcgactagctcaaaggtggcagatatgggggccttaaggcttgtgtgcactgggccatgtaggcccagagcaaggagaaaacagttctacccctactgctcgtctcagggtgagattgtcagtttggacacatcttgacctcactcttgttccggactgactgcccctgtgcccctgttgcatgcctttctagtcccacactactactactactactacttcttcttcttcttcttcttcttcttcttcttcttcttcttcttcttcttcttcttcttcttcttcttcttcttcctcttcttcttcttcttcttcctcttcctcttcttcctcttcctcttcctcttcctcttcctcttcttcctcctcctcctcctcctcctcnnnnnnnnnnnnnnnnnnnnctccccctcctcctcctcctcctccttctccttctccttcttcttttaaagatttatttatttatatgtaagtacactgtagctgtcttcagatacaccagaagagggtgtcagatctctctctctctctctctctctctctctctctctctctctctctctctctctcttccttcaagacagggtttctctgtgtagccctggctgtcctggaactcacttctgtagaccaggctggccttgaactcagagatctgcctgcctctgcctcccaagtgctgggattaaaggcacgtgccaccactgcccggctagtcagatctctttatggatggttgtgagctacccatgtggttgttgggatttgaactcaagaccttctgaccttctgaagagtagtcagtgctcttaacagctgagccatctctccagcccccccccctttttaaagattttatttaatttattttatatatgtgagtacactgtcgctgtcttcagacacaccaaaagaaggcttcagatcccattatagatggttgtcagctaccatgtggttgctgggaattgaactcaggatctctggaaaagcagtcagtactctttaaccactgagccaactctccatcccacacttcttgaagactaagtcaaggaaggtacatttaagccatctgaatccatgttccgataatggttgttaatggttctatgcctcctcctcctccccccctccccgtccccctcctccaggagaaagggtcttactatgttgagtaaagagactttttttttgttctgaactgtaacaccgatttgactcatttaactcatctgatctagcctttcctcatttaaggctgaagtcatgcattaactgctacaaccaggtcacggaaagtgtgaggagctgatggtaactccataggcaagaggttagatctgagagaaccaaggacaacggcagccgagtc

SEQ ID NO: 199 - DNA, 659 bp, Mus musculus
ccaaaattcaggaaaaggaaacttctgagaaaccgaaactgccgcagaaagggcagacccgcagcgcgctccatcctttgcccttcagtgctgcctttgctccgcaccatgaaccacacttctcaagccttcatcaccgctgccagtggaggacagcccccaaactacgaaagaatcaaggaagaatatgaggtggctgagatgggggcaccgcacggatcggcttctgtcagaactactgtgatcaacatgcccagagaggtgtcggtgcctgaccatgtggtctggtccctgttcaatacactcttcatgaacttctgctgcctgggcttcatagcctatgcctactccgtgaagtctagggatcggaagatggtgggtgatgtgactggagcccaggcctacgcctccactgctaagtgcctgaacatcagcaccttggtcctcagcatcctgatggttgttatcaccattgttagtgtcatcatcattgttcttaacgctcaaaaccttcacacttaatagaggattccgacttccggtcctgaagtgcttcaccctccgcagctgcgtccctccttgcccctccctacacgcaggtgtaacactcatttatctatccacagtggattcaataaagtgcacttgataaccaccat

SEQ ID NO: 200 - protein, 173 aa, Mus musculus
PKFRKRKLLRNRNCRRKGRPAARSILCPSVLPLLRTMNHTSQAFITAASGGQPPNYERIKEEYEVAEMGAPHGSASVRTTVINMPREVSVPDHVVWSLFNTLFMNFCCLGFIAYAYSVKSRDRKMVGDVTGAQAYASTAKCLNISTLVLSILMVVITIVSVIIIVLNAQNLHT

SEQ ID NO: 201 - DNA, 21478 bp, Homo sapiens
  misc_feature (1)...(21478): n = A,T,C or G
cgcacccatgatgttctggagcacaggccgctaaaccacagagcagcagagatcaaaggcctgggctctcaaacttagtctaaaatactctgggcctccgccccgtaagccacaggccgcccagtggctgagagaaggggacagttggggccaagcagggctgctgagctgcggggggcgctcccgccactgactctgggggctggccctgtggcatttggctttggtggtccctagggcagctccttcccccacgctaggcaggaaagaggccaggaggcactttctggaaccaggcacttttaatcgtggaaccgaggggcctggagtgtgaggagggaggggcaggatcgggggcagagttagggcccgggaactctcgggttagggtgaagaccccggggtctgactggttcagccttaggtgcccatgttggggctggagggccccaggatcaggatggggcagggatggaggccccacagaaggagggccaggctccggggagtcagtattgggccccaggggcagcagcctggggtcagtgtcctggggctagtgccccagatcaggacccagcctgtcagtcatagtccgcgtcatcaaacttggtgctgaagaaggcggcagagtccttggccagccgggccaggtgcagggcaccagtcaccaccagccccaggagcagcagtggcggcaccagcgtccacatcgcggccaggatgttgtagcacttggctttggagccaaaacgccgggccgcttccaggtcaccaaccaccttctgatctcgggcctgcagagagaccagaccacagggccagatctctatgtgtcctcagggcctgggggcccttccccacccacaccctgggcacctggaaggcccctactgcacccaaaatctggatggaggggtgtggcctgaggagatactccttggggccccagctatggacccgggggccatcccaggccagtgtcagcctatcagagctctctatgggtgagggtcccccagggtgctgagacaccccccaccctgccagccaggagctgaagtcaaagggacctctgttccagaagcccacagcatgtgaaccccctcttgattgcagagacctctgtgggtgcctcccaatggcctctgtgctcttggatgggccagacccccttaagaagaggccccccggccttgccttcgtgaggagctctttcccggccatactgatagctgtgcccacagagcccctcacggacaagcagagccccccgcggcccccagcacggcaaggaccccccacggagctccccatccctcccccttccccccaccttgatggagtagtggagcctcccccgcaacctcggtagggcccctgcccaccttgatggagtaggccagcgccaggaagccgaggcaacacagattcaggtagagggtgctgaacaccgaccagatcaagtggtctcgaggcggggggtgcggggcccccagtgtgagggctgtgtgggcaccggccttgctgggcgtgggggcccgggtgtcctcgcggggatacgccgtgtccatgggttccagcgccgtctcttccacactcagactggtgctgggagggtgggcacccgctcacttatagccctgtcgccctcccggcccagcccctcgacgctatatataacacaaattacagcctgcaggccgagggtgcggcccgccccttagcccccaccccagggagcccctgtccgaggctgccttggaccacccagcagggtccctcctgacagacatcccatcagggagcccccccgcttggaaggctacggccaggcagtggcagagacccccacccatccccccacccccatcaaaggctgctggccaagtgggcagtgggcagaccactggccagagccccctccgtccaggccaagaagagttggaggtgtcgcctcagggccatgggcctcataattcagggatgtacaggagccccctcctcagaaccagagctgctgaaactgcagccccttcattcccagaactcaactctgcccctaacactctcagagcaccagcgccaggccctaggagcgcaggcatccctgcaagggggacagggagggcggctgtcggaggagggcgcgagagagaaggagagaaccacatggggggaaagccagggggtgcagcctgttaggagccggcaggggaacccccagggaccagcaacagctgttaacactggtgtcgggatgcagggagcctgtgggctcctgtggtggacactcccctcagcctcctcggctgccctccctgatcccagaatgtctgtggtgagtggtcctgtttagggctcaaggtccgccccagtcttgtctctggctgtagatgcctgtgtgtgctgacgactcacatttatgtcttcagcccagacttccccccaaagacattggcttggtccccagctctggacacacacacgcaactcctgctctgtggacctccacccacgtgccaacaatagaccctggatcctccctcccaacctcctctgccaagccttccccggagcagtggtggcaactgcaccgggccagaaggctcagcttccccgtctcccagtcggccacactcctgagtgcccaggaccaagctgccctccctcctccaggacgcacactcgccacctgcaggggatggttgggtggggggttccttgctgctgtgcttgagcctgtgaaccccaaatatctgagacaggtctcggttaatttagattattttgccaagattgaggatgtgcctgtgacagcctctggagctcctgaggatctgtacccaaggtggtcggagcacagtttggttttatacattctagggacacaggagacatcagtcaacatatgtaagatgaacattggttcagtctggaaaggcaggacaatgcaaagcaaggcagggaagactcgaagtggggaggcgcttcccggtcgcaggtagataagagacaaaggttgcattcttttgagtttctgacttgcttctccaaaggaggcaaccagatatatgcattcacctcagtgagcagaggggtgactttttttcttttgtttttgttttttttttttttttgtgagacagagtctcactctgtcgcccaggctggagtgcagtggcgtgattttggctcacggcaacctccgcctcccgggttcaagcgattctcctgcctcagcctcccgagccgctggcactacgggctcccgccaccacgcccggctagtttttgtatttgcagtcgagacggggtttcaccatgttggtcaggatgaaaaaagctaactctgtaaagtatttaaagaggtttgtcctacgccgaatatgactgaccacggctcatgatacagcctccagagttccagcaaacgtgccaaaggtggctgggctacagcttggttttatacattgtagggagacagaagttgcaggcaaagacatagatcaatacaagtgtcaacgaaaagagtccaactctgcgaaatatttgaagagatttattctgagccaaatatgagtgaccatggcctgtggtgcggccctcaggaggtcctgagaacatatacccaaggggctcagggcacagcttggttttatacattttagggagacatgaggtatcaatcaaatacatttaagaaatacattggtttggtccagaaaggcgggacaacacaaagctgggggtggggggggtggggggaggggcagcggtgttccaggctataggtgagtttaaacattttcttgttgacaattggttgagcttgtctaaagacttgggattggtagaaaaggagtgttcaggttaagatcaaagattgtggccgggtgcggtggctcatgcctgtaatcccagcactttgggaggccaaggcgggcagatcacaaggtcaggagttcgagaccatcgtgaccaacatggaaaaaccccgtctgtactaaaatacaaaaattagccaggcgtggtggcgcatgcctgtaatcccagctactcaggaggctgaggcatgagaatcacttgaacccaggaggcggaggttgcggtgaaccgagatcgcgccattgcactccagcctgggcaacaagagcaaaactccatctcaaaaaaaaaaaaaaaaaaaaaaaaaagggccaggcgaggtggctcacgcctgtagtctcagcactttgggaggccgaggcgggtgaatcatgaggtcaggagttcgtgaccaccctgaccaacatggtgaaaccccatctctactaaaaatacaaaaattagccaggcgtggtggtgggtgcctgaaattccagctactcaggaggctgaggcaggagaatcgcttgaacccgggaggcggaggttgcagtgagccaagatcagatcgtgccattgcactccagcctgggtgacaaagcgagagactccgtctcaaaaaaataaataaataaaaaataaagattgtggaaaccaaagttcttttgaagtcttatagtggctgcccttagagacaataggtgaccaatatttcctattcatatcttaattaatctcttcaggattgggagggtctggaagaaaaagatctggctatgttaactgagattctttacagatgcaaattttcccccacaaagaacagctatgcaggggccatttcaaaatatggcaaagaaacatgtttttggggtattttgattttcttccttgtttcataatgttatgccagagtcaggttggaaagtaagtcacgatatatagggttaaataaaactcatctggttggccgggcatggtggctcatgcctgtaatcccagcactttgggaggccgcggcaggcagatcacctgaggtcaagagttcgagaccagcctggccaacgtggtgaaacctgtctctactgaaaatacaaaaacaaaacaaacaaacgaaaaccaaaactcatctgatgagaatttaccatttgtaggtaaattccccagacccctttgataggaacttgggcaagataaaaaagtcagagtttagtcctcacgagtaaggtgtacattgcttctgccaggaaaggcaagacatctcaaaggggtgtggtcacaggtcacagtgataccagtgggcttggggaggtccccaattgccagtgggacctggacccccacgggtgtccaggctcttggcacaagaagaaaattcaaggacgagaccgaaaatagtgaaagtagggagatttgttgaaaagtgaaggccaggcgcggtggctcgcgcctgtaatcccagcactttgggaggctgaggcgggtgtatcacctgaggtcaggagttcgagatcagcctggccaacatggcgaaaccctgtctctactaaaaatgcaaaaattagccgggcgcggtggtgcgtgcctgtgatcccagctaatcgggaggctgaggcaggagaatcacttgaaccgggtaggcagaagttgcagtgagatgagatcgcgccactgcactccagtctgggcgacagagcgaggctccctctcaaaaaaaaaagaaagaaagaaaaaaaagagaagtgaaaagtacacactcaagaaagggccgtgtgggcggagactcgagagagtcacttgcaaggggtttgggtgggggttccatctttcagggtttctttcaccaagcgggggagtatcatgaagattcttgcaagaaggtgacgatttctcagaactgaggtgccttgcattttttttttcaagacaacatagagggtctttattggatagcagctgagagaccatgcctcagtcctcttgagggacgcctttccccccggcgtaccacttctttcccacgtttcccttctctgcaggctacagcttgatgcaaaagaaagggatcgtcctacaggtccttatacacaacctttgagggcacagtttggaggtggagtggcagaggacatttgtaaaagtgggacagcaaagtttcactgtagcccacgaggaagtagaacttgcgggcaggcaagtgcctcgggaccagggcacagatctccaaccggttggcccagcactgtaaaaccagcgggtcagccaggcagcccgggaaggcaccccacatgaacttgcgacggaaagcatcctccaccgttcgctccgccgcatggtcctccccaccagggttccccgcgtgagcgacctctggccctcacggcgggcgacgaagtgcggcgcgtgtgcgtcctcataggtcaccggcttgtccccctggcctcggcggactcgggccgccggttcttgttacagaccgcggaagtgtgcggggcccgccccgcgcaaggcagctctcggccccgggacggcacccggggccacccgccacccgccacccgccgcacgcggaggccgccatcttggccgagcgcccgccatgtttacagcagatctgtgtgttcctggaagtgtcgcggtgcgggtgggtgtgggccgagtacgttcctatgaggaggtcctaggggacgcataggtcgcattcagcgccgtggtggctctggtctgtcttagccagcttggcccacactgcttttgaaggtctcatcggcccctcgcttctgcagcaacctcaacagtctcttttgctagtcatgcgaggctgctgcttagaatgttctgttctcccgcagccgctccatattattctgtctcattttgtggatttaaagattttctgatgggcagctggcttaaagagttcagctttggggccgggcgcggtggctcccgcctgtaatcccagcactttgggaggccgaggtgggtggagcacgaggtcaggagatcgagaccatcctggctaacacggtgaaaccccgtctctactaaaaatacaaaaaattagcaggacttggtggcgggcgcctgtagtcccagctactcgggaggctgaggcaggagaatggcgtgagcccgggaggtggaggttgcagtgagccgagatcgcgccactgcagtccggcctggttgacagagcgagactccgtttccaaaaaaaaaaaaaaaaaaaaaaaaaaagttcagctttgcctaaagagttggttagtcgaaagaaattacttgagtttacataaccggggctgtggaagccaaggggcttgttatgcagatgaggcctccaggtggcaggctggagacaaggatgataaaaaaaatctctcttttccacccttaaaaagggctcttagttaaatgtctgttctataggaaaagacctagaaagggaaggagattctctccagaatgcaaatttccctaataagagacagttgtgcaaggccatttcaaaatatgccaaataaatatattttgaggctgtgcatggtggctcacaccagcactttgggaggatgaggcaggtggatcacttgagcccaggagctggagaccagtctgggcaacacagtaaggccccgtctcaaaaataaaaatacatatattttgggggtaaataatttttatttccttcagagcctgctatttgttgtgaaaggaaaataaatattaggaccccgaaatcactgaaccaaaaggagacgtcaagctgggaactgcttagggacacctgcctcccgttctactcctaaaaacggctgctgccgaaacaaaaagctatatacctccctcacagtttgtccacagggaatttccttgtggacaaaagacaaatggaactcaaacttacccttttgctcgctgagataatgcatatctgattgcttcctttgcaaaggctcatcagaaactcaaaacaatgcgatcctttgtctcttctcaacctatgacctggaagccccctccccacttcgagttgtcccgtctttccagactgcactaatgagcgtcgtgcatatattgatgtccatgtctccctgaaatgtataaaaccagctgtgccccgatcatcttgcgcaccctgtcaggacctcctgaggctgtgtcacccgctcatccttaaccttggtcctaaatcgactgagaactttctcagatatttagggtttacactgtcatgtgacgctgtaccacagtcagttggaatttggtaccttattgctacgaagagtctgttttgtcagtactatgagctccatctcagtgttaatgctggtcggttgtgcctaaactccacagggaggggatataagtaggcctgtccaacctccctgtcccttcgaggctgtgaattcagtttttcaggtttgtttgggacccccttggccaagggagctccattcagtcatgggggcaggggaggcttagatttttatttttggttttcagtcagcactccagtccagtcaggagggcttcagaccacgaagaggggaggtgtccccacggcagagctagacacagatcccaggacattctgtgtgtgggggagacatggcccagaatagaaggcctgtagaggcctggacatggctaagcccttagagctcaccccagccagcagaaggaggaggacttagggtgttcgacgtcgagaagcactgtgagtcgatggtagacacagccattgttaaagttaaatcttaggaatcttagaaattatcaataaaatttatcttatagagccaaagtcatcgttactcaaacacatcactctgcagttacacggctgcacgctaccgtcatgtaaactctggaatactgacgtggacctgaccacccgctgaggtgaaaggctacagcagggtgagcagctgcccatctctgtaaattccaccctcagcgatgtcctctgcggagtctggcctggtgggagaataagcccaggaaaatgggcccatgtagcacatcaggaattaaacagggcgcaggtcgcggtgcacataggcctgcaggccacgttcctgcccctgtgacccgcactgtcccctctgacaagctcaagtgcacagcatcagctctgtttgctgcaatagcctctgccaaggaaggtccaggaagaagcccagaggccacacaaggtgtttccacagggaggctgtaacctcaggagctgctcagaggcagcaccggttcatgggaaaaacaggcggcaactacaggaagcagctggcacccgtgtgaggacccagggaagaggcagagatgatcagaacctggaaatctggagggtgccccagggaccagccagccagagctctgggcagcgtgggtgctgctgggctgtgtggagcgggtctgggagccgtcacccaggtgggcctccaggggaaagggccatggcttctaactccaccgtccaggtctctgctattggcatcccacagccccctcttctgtcagtgctcccagagtcccctttcctgggcctggagggctcctttggggcaggcaacattggccgccaaccctctgacctgcaccaggagacacggggacctttaacccccaaacccgcatggagcaggactgcaaccccagcaaaggacaagggatgtcagcagatgaggcctgtgacaagtgagatgagggcttttttttttttttgagacggagtctggctctgttgcccaggctggagtgcagtggcacaaccttggctcactgcaagctccgcctccccggttcacgccattctcctacctcagcctcccaagtagctgggactacaggtgcccgccatcacacccggctaatttttttttgtatatttagtagagacggggtttcaccgtgttagccaggatggtctcgatctcctgacctcatgatcctcccacctcagcctcccaaagtgctgggattacaggcgtgagccacggcgcccggcagaggtgagggctttggggaaacggttgtggggcctggagtgtggaggcgtcagcgcaggcctggcaggagccctgaaccgggacagtgaggtcctgcagctgctggcctggggtgtggagactcccaacacaggggaagtctccaggaccccacaccactaacaagatgagacttgtgctcctttgggctctagagaggaagcccctcttagccctcagcccctctttcctccctctcctaaagtaatttgatcctcaggaatttgttctgccctcatctggccctggccagctctgcatttgacaaatgccaggaagaggaaactgttgagaaaacggaactactggggaaagggagggctcactgagaaccatcccggtaacccgatcaccgctggtcaccatgaaccacattgtgcaaaccttctctcctgtcaacagcggccagcctcccaactacgagatgctcaaggaggagcaggaagtggctatgctgggggtgccccacaaccctgctcccccgatgtccaccgtgatccacatccgcagcgagacctccgtgcctgaccatgtggtctggtccctgttcaacaccctcttcatgaacacctgctgcctgggcttcatagcattcgcgtactccgtgaaggtgcgtatggccctggcggaaatccagggggtgccggtgagcctggggctccacctgcccacatgctgcctggggtggggacttgtgtgtccctgtgactgtgagtttgtgtgcacgtctgtcctgtgtgtgcccacgtcagtggctttgtctgtgtgatctgtgtgtgtgtgtggcttggggaatctgcccagtgcaggtctaggaggaggctccaggaggctggctggctggctcagagtctgtccccggctatccactagcccagagcagttctccctatagcccagtaagaaattacaccttcaccttccagactgacacccaggctctcccagaaagtgagaagggaactcacaggtgacttcaccccatggtggggagaacagcctgtgctggggccaaggcagaaggaggatgagccccgaggctcctggagagtctgagccgggtgaggaaggggaggaggtggtccctgatctcagggcagggaggagacagtgaggagctggagccatagcacgcggctctcagctgggggatcctggtcccctcaccatctcctctcccccagtctagggacaggaagatggttggcgacgtgaccggggcccaggcctatgcctccaccgccaagtgcctgaacatctgggccctgattttgggcatcttcatgaccattctgctcatcatcatcccagtgttggtcgtccaggcccagcgatagatcaggaggcatcattgaggccaggagctctgcccgtgacctgtatcccacgtactctatcttccattcctcgccctgcccccagaggccaggagctctgcccttgacctgtattccacttactccaccttccattcctcgccctgtccccacagccgagtcctgcatcagccctttatcctcacacgcttttctacaatggcattcaataaagtgtatatgtttctggtgctgctgtgacttcacctggggagcggtcctgctggttctgagattaaatgtaatgccaaacgttcttgccttagccacaccaaagaattgggtgtggcggctgcccgcggcgagtgatggagacacagaccaagagaagaaaaaaactgtaggttttattgagcagagtgacagtacaaagcttacacagcatggaaggggtccggagagggtagccactgttggttttgggtgattgccttttaatctctttaaggcgggaaatacatgtggtgggaagatgttaccagagagagaaacaaaggcagtaaattattttgtgacatgtcttagattttgaggaaaaacagaattgcaacttaggttttatctaattttatctactttatgaccttgcagcagcatggcaaaagagacaggattttacaggactttacaaagtatgttcacaaggaattggaattgggagcatagataaggtccgctggtcacagaaaaagggtcttttaacattccttttagttttaggggagggggaaggaagagagggagagaggacacagggaagcttacagcagaatttttgctgtttatagctttcttggggaaggaaacacatgcacaaatcctggtgttaggaatattttaggcatgtatcttcagtactcttcatccaggaccgaagtaagtcctgatgcaggaaatgagtgtttcacagctttctgaacccctactcgacccaggaagcccagctggaccctcctttcatgagcaggttggtcagcccctgcactgccccttccagcctctgtgcatctcttggggacggggcaagtgctcaggccttctggtttcgggcctcctgccgtgagcagcagctggatccaggaccctgggaggagttcctgtgtcctgcaggtctcagctcctactcaacgtgggctctttccgggaacgtcagtgctgagtccgggacaccctgggcccaaggccacgctcgcggcctgtcggcaatccaggctgtcggctcaggacagagggaagggttaagcccccagcagggccagggaggggcaaggtggcaccggctccccagctgctcccaggccctgctctgtggtgctggggacctggctttagttcctcggggtggagggggcaccgcgctgcctgcctccgagctgtctggagcagccagtcctgcagatgtgggcagctcagggcccgtgggagggagggggctttgtgcccagggcagcagctgaaggagccccgggcctcgcagcccctcctgggtgaccaggtgctgcttcgtggcagctgccccctcccgtccagcgggtatgggccctgctcccccgtggtgggggcggcgcaggagagtggagcgaccctcatcgaagttacctctacccgggtctgagcccccggacagacacccccgccccgacctggttacagcgcccttccccggttcggtctccggtgtgcgcatgtggggtgccccatgggcggccgcggtgggagctggggtggccatgcgcgcccccgccccgccgtccacccgcgactccaggtctggatctactcgccctccccaccctttcccgcccccagccccggagccgcgctctcaccccaggggcggcaagggcgatggacgcggaggaagcgccctctccccctcgggggtctcccggaggcgagtcccgaagggggcgaactccgaagtgggtcccgggtgggaggcgcgcggccccgcccggcggggagggggaagcggcggaggcgggtgctcaacggcgcccctggcggcggccggcgcaggtgcaggtcccggaggaggctccgcccgcagcccagacccccgcggggtgggcgggacgcggaccctgagacccgcagcgccggacccggacgggagcccctctcctccccctcgggcacgtccccggccgagccttcccgccctcctctggggctcccacctccccttcacccgcgggggacccgatttccgcgtctcctgggcccctccctgggcagggggtccagccggaatccaggagtgacctgctggaggacttggtggccagggagtcaccctgggagcccggtcctgtgaccccttaatggattctctgcgctcctgggcgggccccttggtcgcatcggggcaggggaatcgcaataaggaaagtgtaattcacgcagagccggctgcgggggagacgggagttttattattactcaaatccttctccccaaaaacgtggggatccgagtttcgaaggatgatatggtgggtaggcggccagtgagtcaggagcgctgaccggtccggttggagatgaagtcttggggagtcgaagctgtcttcccaaccctaacccagctcctcggtgggggccacaggaccacatgagcaagattgtggatttaggtggtgccagctgatccattgagtacagggtctgtaaagtatctcaaactctgatcctaggttctacagtagtgctgtgatccccgggagcaatttaggggtggcggggtcagaatcttgcatcctccagccgcgtgactcctaaaccataatttctaatcttgtggctaatttgttagtcctgcaaaggcagtctggtcctcaggtaggaagggggcttgttcagccttgatctataaactgtttctctccagattagtttaggctaagcccagggatgagcaagggcagcttggaggttagaagccaggcggagtgggttagggtcagacctccttcactgtcatcatattctcagttatgacttttgcaaaggtggtttcagttccatgcctgcccctcagaatcctgtctccctcttgtgccctgcagtttcttccttcctaaactgcccgtgatttaaagaagcttccaaaataccttccacgggaaattcaagccccaccccactccgcagtgatgtgtggcctttgataggaggtcacagagccttgtgaggagtttgtgtaggcagtcctcgatgtctcagagcacgctccatccacatccacccctggcttgccgggacccagacatagtttggtctaagtggcctgggatgtggctggggctggaggcggcctgttgaggggtgggtggagggtgggggggttggtgtgcgatttggggaggcccagcagggactccaagcaagggcaagggctagttctttttttttttttttagctgcaatgggtagggaggggctgatggttttggagctcggtgtttgagatgttaagtctgctgatgctcctggccgaataaaggccaaataaagccctttctttcctcaactcgatgtctgagggttttgtctgtggctcgtcctgctacaatttctaacgttaccagtaattttaaagctagcttattaaagattctacttaagtcacatgaacgtgaaaagcatttaggcttattatttaatttatgagtactctttaagtttaagctaaatttggtaacttgtggccaaaaacacataacgaaatatgtgtatgtgcacatatacacacatacacactcaagcaaaagtatggttttacttcagaactccagccatgagatagtaatacaaattcattggtttacacaaacaataaaaagaaatggttggatgcaaacagtggattttatctctgtagaaaagtaacagcagacttaaagcaggcagaaacgaaagcagaaagagaacttaagaacattacattaataattgcaggcccacctttgggctctgatttttcctttatgtaatttgcaatttgtaattcatgatccttgtgcctgagggctcccttctgctactcagtctacaattccccgtccctgtgaaggggcacccaggcctgacagccccagacttggctttgccaaccctccaggtctctcctgcatggctaggacccaacgcctaggtcatccagcactcaccccaaccaaagccatgggaattgctgggacccggaaggtagggggtggcacatgtgtgccctgtgctctgaagctgcccctacaggccctggaatcctccccgtgtctcaacacactaccctctggggagtcagttctccccagagtccccgttcctgggcctggagggctgctttggggcaggaaactttggccaccaggcctctgacctgcaccaggagacactgggaggtttagtccccaaacccgcacagagcaggactgcagcctgaggaaagagcaaggatttcaggagagaggcctgcgacaagtgaggtgagggcttttgggggattgtcctggcgcctggagtgtgggggcctggcaggggccctgaaccgggacagtgaggtcctgtacttgctggcctggggtggacagaacccaagcctgggtaaaatccccagggccccctaaacccaacacttaggaagtcactagtcctgacttgagtttctgatgaggaagcctctctccttagccttcagcctttcctcccaccctgccataaagtaatttgatcctcaagaagttaaaccacacctcattggtccctggctaattcaccaatttacaaacagcaggaaatagaaacttaagagaaatacacacttctgagaaactgaaacgacaggggaaaggaggtctcactgagcaccgtcccagcatccggacaccacagcggcccttcgctccacgcagaaaaccacacttctcaaaccttcactcaacacttccttccccaaagccagaagatgcacaaggaggaacatgaggtggctgtgctgggggcaccccccagcaccatccttccaaggtccaccgtgatcaacatccacagcgagacctccgtgcccgaccatgtcgtctggtccctgttcaacaccctcttcttgaactggtgctgtctgggcttcatagcattcgcctactccgtgaaggtgcgtatggccctggcggaaatccagggggtgccggtgagcctggggctccacctgcccacatgctgcctggggtggggacttgtgtgtccctgtgactgtgagtttgtgtgcacctctgccccgtgtgtgctcacgtcagtagctttgtctgtgtgatctgtgtgtgtgtgtggctttggggaatctgcccagtgcaggtctaggaggaggctccaggaggctggctggctggctcagagtctgtccctggctatccattagcccagagcaattctccctatagcccagtaagaaattacaccctcaccttccagactggcacccaggctctcccagaaagtgagaagggaactcacaggtgacttcaccccatggtggggagaacagcctgtgctggggccaaggcagaaggaggatgagccccgaggctcctggagagtctgagcccgggtgaggaaggggaggaggtggtccctgatctcagggcggggaggagacggagccatagcacgcggctctcagctgggggatcctggtcccctcaccatctcctctcccccagtctagggacaggaagatggttggcgacgtgaccggggcccaggcctatgcctccaccgccaagtgcctgaacatctgggccctgattctgggcatcctcatgaccattggattcatcctgttactggtattcggctctgtgacagtctaccatattatgttacagataatacaggaaaaacggggttactagtagccgcccatagcctgcaacctttgcactccactgtgcaatgctggccctgcacgctggggctgttgcccctgcccccttggtcctgcccctagatacagcagtttatacccacacacctgtctacagtgtcattcaataaagtgcacgtgcttgtgatgatgctgtgacttcatctggagtgggggccctgctgaggggtcccggcctagtcctgagacagcccagtgctcagcccctgcacagccgtatccctcctctgtgaagctctcaggggagcagggatatgctcagaatctgctggtttccgcctcctgctgtgggcagcatctggaccaggaacgtggggtgggcatttctctgacaccaaggtaaggacacactgtccagaatacctttgggccaggacaacctgcctctgagctggctgggcagctggtcttgcagatgtgtgcaccttaggccctgtgggaggggcaggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 202 - DNA, 904 bp, Homo sapiens
caacacaggggaagtctccaggaccccacaccactaacaagatgagacttgtgctcctttgggctctagagaggaagcccctcttagccctcagcccctctttcctccctctcctaaagtaatttgatcctcaggaatttgttctgccctcatctggccctggccagctctgcatttgacaaatgccaggaagaggaaactgttgagaaaacggaactactggggaaagggagggctcactgagaaccatcccggtaacccgatcaccgctggtcaccatgaaccacattgtgcaaaccttctctcctgtcaacagcggccagcctcccaactacgagatgctcaaggaggagcaggaagtggctatgctgggggtgccccacaaccctgctcccccgatgtccaccgtgatccacatccgcagcgagacctccgtgcctgaccatgtggtctggtccctgttcaacaccctcttcatgaacacctgctgcctgggcttcatagcattcgcgtactccgtgaagtctagggacaggaagatggttggcgacgtgaccggggcccaggcctatgcctccaccgccaagtgcctgaacatctgggccctgattttgggcatcttcatgaccattctgctcatcatcatcccagtgttggtcgtccaggcccagcgatagatcaggaggcatcattgaggccaggagctctgcccgtgacctgtatcccacgtactctatcttccattcctcgccctgcccccagaggccaggagctctgcccttgacctgtattccacttactccaccttccattcctcgccctgtccccacagccgagtcctgcatcagccctttatcctcacacgcttttctacaatggcattcaataaagtgtatatgtttct

SEQ ID NO: 203 - protein, 132 aa, Homo sapiens
MNHIVQTFSPVNSGQPPNYEMLKEEQEVAMLGVPHNPAPPMSTVIHIRSETSVPDHVVWSLFNTLFMNTCCLGFIAFAYSVKSRDRKMVGDVTGAQAYASTAKCLNIWALILGIFMTILLIIIPVLVVQAQR
